United States Patent 8,952,217 (PROCESS FOR DECREASING VERBASCOSE IN A PLANT BY EXPRESSION OF A CHLOROPLAST-TARGETED FIMD PROTEIN) - sequence listing, part 14

SEQ ID NO: 73360 - DNA, 927 bp, Saccharomyces castellii
  CDS (1)..(927)
atgagctctaaagaagaagttaaaaaggaatccaatttcgctatcgatttcttaatgggtggtgtctccgccgccgtggcaaagactgctgcttcccccattgaaagagttaaattattgattcaaaatcaagatgaaatgattaaacaaggttcattggattcgaaatataagggtattatcgaatgtttccaaagaactgcaaagactgaaggtatcatagcgttctggagaggtaatactgctaatgttattagatattttccaacacaagctttgaatttcgcattcaaggataagattaaggccatgtttgggtttaagaaggaagaaggttatgggaaatggttcgctggtaacttggcttctggtggtgctgctggtggtttgtcattattattcgtctattctttggattatgcaagaactagattggctgccgatgctaaatcttccaagaagggtggttctagacaatacaaggggttgattgatgtttacaagcaaactttggctactgatggtatggctggtttataccgtgggttcttaccatctgtcgttggtatcattgtttacagaggtttatactttggtctatatgattctttgaagcctgccgtcttgactggttcattggaaggttccttcttagcttcattcttgttaggttggattgttactactggtgcctccactgcttcatacccattggataccgttagaagaagaatgatgatgacttctggtcaagccgttaagtacgatggtgcctttgactgtttcagaaaggttgttgccgctgaaggtgtctcctctttgttcaagggttgtggtgctaacatcttaagaggtgttgctggtgcaggtgtcatctccatgtatgatcaattgcaaatgatcatgtttggtaagaagtttaaatag

SEQ ID NO: 73361 - protein, 308 aa, Saccharomyces castellii
MSSKEEVKKESNFAIDFLMGGVSAAVAKTAASPIERVKLLIQNQDEMIKQGSLDSKYKGIIECFQRTAKTEGIIAFWRGNTANVIRYFPTQALNFAFKDKIKAMFGFKKEEGYGKWFAGNLASGGAAGGLSLLFVYSLDYARTRLAADAKSSKKGGSRQYKGLIDVYKQTLATDGMAGLYRGFLPSVVGIIVYRGLYFGLYDSLKPAVLTGSLEGSFLASFLLGWIVTTGASTASYPLDTVRRRMMMTSGQAVKYDGAFDCFRKVVAAEGVSSLFKGCGANILRGVAGAGVISMYDQLQMIMFGKKFK

SEQ ID NO: 73362 - DNA, 993 bp, Arabidopsis thaliana
  CDS (1)..(993)
atgcagacggaagctagggttggtgtgagctcaggacatggcgtagcttcgtcttctcatcgtttaacgcaggaccagagatcacatatcgaatcggcgtcgcagctcttagccggaggactcgctggtgcttttagcaagacttgtactgctcctctatctcgtctcaccattctcttccaggtgcaaggtatgcacacaaatgctgcagctttaagaaagccaagcatattacacgaggcttcacggatattgaatgaagaaggattgaaagctttttggaaagggaatctagttactattgctcaccggcttccatattcttctgttaatttctacgcatatgaacactacaagaagttcatgtatatggttactgggatggaaaatcacaaggagagtataagttcaaacctttttgtacattttgtagccggtggtttggctggaatcacagctgcttctgccacttatccacttgatcttgttagaactcgtcttgctgctcagacaaaagtaatctactactcgggtatctggcatactctgcgctctattacaaccgatgaaggtatcttgggcctctacaagggactaggaacaacgcttgtgggtgttgggcctagtattgccattagcttttctgtgtatgaatcattgagatcttattggaggtcaactaggccccatgattcccctatcatggtcagtctagcttgtggaagtctttcaggaatagcatcttcaacagctacgtttccattggatctggtgagaagaacgaagcagctggaaggaataggcgggcgagcggtagtgtacaagacaggtttgttaggcacattaaagcgtattgttcaaacggaaggagcgagaggcctgtacagaggaattcttccagagtactacaaagtggtacctggtgtagggatttgcttcatgacctacgagacactcaagctttacttcaaggatctttcttcgaatctataa

SEQ ID NO: 73363 - protein, 330 aa, Arabidopsis thaliana
MQTEARVGVSSGHGVASSSHRLTQDQRSHIESASQLLAGGLAGAFSKTCTAPLSRLTILFQVQGMHTNAAALRKPSILHEASRILNEEGLKAFWKGNLVTIAHRLPYSSVNFYAYEHYKKFMYMVTGMENHKESISSNLFVHFVAGGLAGITAASATYPLDLVRTRLAAQTKVIYYSGIWHTLRSITTDEGILGLYKGLGTTLVGVGPSIAISFSVYESLRSYWRSTRPHDSPIMVSLACGSLSGIASSTATFPLDLVRRTKQLEGIGGRAVVYKTGLLGTLKRIVQTEGARGLYRGILPEYYKVVPGVGICFMTYETLKLYFKDLSSNL

SEQ ID NO: 73364 - DNA, 993 bp, Arabidopsis thaliana
  CDS (1)..(993)
atgtgcatttcaaaagaagacgaagaagatccatcaagaaatcgaaggaatcaatcaccattatcgcttcctcaaactctgaaacatttccaaaaagatttgcttgctggtgctgtaatgggaggtgttgttcacacgatcgtggcaccaatcgaaagagccaagcttttattgcagacacaagagagcaatatcgcaatcgttggagacgaaggtcacgcagggaagagaaggtttaaaggaatgtttgattttatcttccgtactgttagagaagaaggtgttttatctttatggagaggcaatggaagcagtgtgcttcgttattatccttctgttgctcttaatttctctcttaaggatctatatagaagcattcttagaaacagtagctctcaagagaatcatatcttctctggtgcattagctaatttcatggctggttctgctgctggttgtactgctttgattgttgtttatccgcttgatatcgcacatactcgtttagctgctgacattgggaagcctgaatctcgtcagttcagaggaatccatcatttcttgtcaacgattcataagaaagatggggttagaggaatctatagaggcttacctgcgtctctacatggtgtgattattcaccgtggcttatactttggagggtttgatacagttaaggagattttctcagaggatactaaacctgagttggcattgtggaagagatggggtttggctcaagctgtgactacatctgctggtttggcttcttacccgttggatacagttcgtagacggataatgatgcaatccgggatggagcatccgatgtaccgtagcacattggattgttggaagaagatatataggagtgaagggttggcttcgttttaccgtggagcactctctaatatgtttaggagcaccggttcggctgctatcttggttttttatgatgaagtgaagaggttcttgaattggggagggatctaa

SEQ ID NO: 73365 - protein, 330 aa, Arabidopsis thaliana
MCISKEDEEDPSRNRRNQSPLSLPQTLKHFQKDLLAGAVMGGVVHTIVAPIERAKLLLQTQESNIAIVGDEGHAGKRRFKGMFDFIFRTVREEGVLSLWRGNGSSVLRYYPSVALNFSLKDLYRSILRNSSSQENHIFSGALANFMAGSAAGCTALIVVYPLDIAHTRLAADIGKPESRQFRGIHHFLSTIHKKDGVRGIYRGLPASLHGVIIHRGLYFGGFDTVKEIFSEDTKPELALWKRWGLAQAVTTSAGLASYPLDTVRRRIMMQSGMEHPMYRSTLDCWKKIYRSEGLASFYRGALSNMFRSTGSAAILVFYDEVKRFLNWGGI

SEQ ID NO: 73366 - DNA, 1041 bp, Arabidopsis thaliana
  CDS (1)..(1041)
atgatttcaggttatagcaaggagctcgtgatcatgagtggtacagagttagatgagcctggaaagttaaaacgtgctgtcattgatgcttctgctggtggtgttgctggtgcgatttcacgtatggttacctctccccttgatgttatcaagattagatttcaggttcagttggagcctacagctacatgggctctgaaagattctcagctgaaaccgaagtacaatggtttgtttcgaacaacgaaggatatctttagagaggaaggtttatcgggtttctggcgtggaaatgttccagctttacttatggttgtgccttatacatccatacaatttgcagtcttacataaggtgaagtcttttgccgctggttcatcaaaggccgaaaatcatgctcaactgagcccttatctttcttacatcagtggggcactagcagggtgtgcagcaacagttggatcgtatccgtttgacctattgcggactgtattggcgtcccagggtgagccaaaggtgtatccaaatatgaggtcagcatttctgagtatagtgcaaactcgtggaatcaaagggttgtatgcaggattgtcccctactctgatcgagatcattccttatgctggtctgcagtttggcacctatgacacatttaaacgctggagtatggtatataataagcgataccgatcttcttcatcaagctcaacgaatccaagtgatagtctttctagctttcagcttttcctttgcggtttagcttcgggcactgtttctaaactagtctgtcatccgcttgatgttgtcaagaaaagattccaggtcgaaggtctgcaacgtcacccaaaatatggagcccgagtagagctgaatgcttacaagaacatgtttgacggtttagggcagatattaagatctgaaggttggcacgggctttataaaggcattgttccatcaaccattaaagctgcacctgctggtgctgtaacatttgtggcctatgaacttgcatccgattggtttgaggcaaatttgacctga

SEQ ID NO: 73367 - protein, 346 aa, Arabidopsis thaliana
MISGYSKELVIMSGTELDEPGKLKRAVIDASAGGVAGAISRMVTSPLDVIKIRFQVQLEPTATWALKDSQLKPKYNGLFRTTKDIFREEGLSGFWRGNVPALLMVVPYTSIQFAVLHKVKSFAAGSSKAENHAQLSPYLSYISGALAGCAATVGSYPFDLLRTVLASQGEPKVYPNMRSAFLSIVQTRGIKGLYAGLSPTLIEIIPYAGLQFGTYDTFKRWSMVYNKRYRSSSSSSTNPSDSLSSFQLFLCGLASGTVSKLVCHPLDVVKKRFQVEGLQRHPKYGARVELNAYKNMFDGLGQILRSEGWHGLYKGIVPSTIKAAPAGAVTFVAYELASDWFEANLT

SEQ ID NO: 73368 - DNA, 1077 bp, Arabidopsis thaliana
  CDS (1)..(1077)
atggaagctcgagtcggtgtagtggtggaaggaggacagagagctcttaatacagccaccaccaccgccgttcataacaccgtcgtagacgccggaaacaggaaacttttacagcaacaaccacagacgcaacagacacaaagctgtcatcaacatcaccaaagtaataaacagtcgttgaatcagcagcaaggccatttcggcaccgttgagcgtcttctcgccggtggaatcgccggcgcatttagtaagacatgcaccgctcctcttgctcgtcttacaatcttgtttcagatacaaggtatgcagtcggaagctgcaatcttgagcagtccaaacatttggcatgaagcttcgcgtattgttaaggaggaaggttttagagcattttggaaaggaaacttggttactgtagctcatcggcttccttatggtgcagttaacttctatgcatatgaagaatacaagactttcttgcactcgaatccagtcttgcagagttataaaggaaatgcgggtgtggacatttctgtgcactttgtaagtggtggcttggctggactaacagctgcttcagctacctaccctctcgatcttgtaaggacacggctttctgcacagggtgttgggcatgccttccgtaccatttgcagagaagagggaattttgggtctatataaaggacttggtgcgacattgttgggtgtcggtccaagtcttgcaatcagcttcgcagcgtatgagacttttaaaacattttggctctctcataggcctaatgattcaaatgccgtggttagtcttggttgtggcagtctctccggaattgtttcctctacagcgacattcccattggacctggtgagaagaagaatgcagttggaaggagctggtgggcgagcgagagtgtataccacaggactctttggaacattcaaacacatatttaagacagaaggcatgagagggctatacagaggaatcataccagaatactacaaagtggttcctggtgttggcatcgccttcatgacattcgaggaattgaagaagctcttatcaactgtccctaattaa

SEQ ID NO: 73369 - protein, 358 aa, Arabidopsis thaliana
MEARVGVVVEGGQRALNTATTTAVHNTVVDAGNRKLLQQQPQTQQTQSCHQHHQSNKQSLNQQQGHFGTVERLLAGGIAGAFSKTCTAPLARLTILFQIQGMQSEAAILSSPNIWHEASRIVKEEGFRAFWKGNLVTVAHRLPYGAVNFYAYEEYKTFLHSNPVLQSYKGNAGVDISVHFVSGGLAGLTAASATYPLDLVRTRLSAQGVGHAFRTICREEGILGLYKGLGATLLGVGPSLAISFAAYETFKTFWLSHRPNDSNAVVSLGCGSLSGIVSSTATFPLDLVRRRMQLEGAGGRARVYTTGLFGTFKHIFKTEGMRGLYRGIIPEYYKVVPGVGIAFMTFEELKKLLSTVPN

SEQ ID NO: 73370 - DNA, 1158 bp, Solanum tuberosum
  CDS (1)..(1158)
atgggagtatgtctatttctcatttggggctccaatggagtctccaagattcaaacttttgtcctggtggacttgtttgcatcagttggtcagatgggaagtatgggttttggtgtttcatcacctaatccatctgattcccgggatgaaaatggtggattcaagctaccttattccgatttgtgtatgaaatatttatcattctctgaggggtttaagattgtagggaatggggaggaagaaggggttgtgaaggagaagaagaagaaaggtgggctaaagattaagcttaaggtttcaaatccttcactaaggaggttaataagtggtgcaatcgcaggggcgatatctagaactgctgtagctccattgggaacaataaggacacatttgatggtgggaagtagtggacattctagtactgaggtgttcaatagtatcatgaagactgaaggttggactggattgtttaggggtaactttgttaatgtgattcgagttgcccctagcaaagctgtagagctttttgtgtatgatactgttaataagaacttgtcatctaaacccggtgagcaatccaaaattccaattcctgcctcattagttgcaggagcgtgcgccggagtcagctctaccttactgacatacccacttgagctagtgaagactcggttgacaattcagagaggagtttacaatggtttacttgatgcatttgtaaaaatattgaaagagggtgggcctgctgagctctatagaggtctcactccaagtgttataggagtcattccctatgccgccacaaactactttgcttatgattcattgcggaaagcctacagaaagattttcaaggaagagaagattggaaacatagagactcttctgattggatcagcagctggtgctatatctagcactgcaacctttcctctggaggtggctcgtaagcacatgcaggtgggtgctgttagtggaagagcagtttacaagaatgtaattcatgctcttgtgagtatacttgaacaggatgggattcatggtctgtataaagggcttggtcccagctgcatgaagttagttcctgccgcaggaatatctttcatgtgttatgaagcatgcaagaggatattgatagaggcagaaaatgaagagtaa

SEQ ID NO: 73371 - protein, 385 aa, Solanum tuberosum
MGVCLFLIWGSNGVSKIQTFVLVDLFASVGQMGSMGFGVSSPNPSDSRDENGGFKLPYSDLCMKYLSFSEGFKIVGNGEEEGVVKEKKKKGGLKIKLKVSNPSLRRLISGAIAGAISRTAVAPLGTIRTHLMVGSSGHSSTEVFNSIMKTEGWTGLFRGNFVNVIRVAPSKAVELFVYDTVNKNLSSKPGEQSKIPIPASLVAGACAGVSSTLLTYPLELVKTRLTIQRGVYNGLLDAFVKILKEGGPAELYRGLTPSVIGVIPYAATNYFAYDSLRKAYRKIFKEEKIGNIETLLIGSAAGAISSTATFPLEVARKHMQVGAVSGRAVYKNVIHALVSILEQDGIHGLYKGLGPSCMKLVPAAGISFMCYEACKRILIEAENEE

SEQ ID NO: 73372 - DNA, 927 bp, Chlamydomonas reinhardtii
  CDS (1)..(927)
atggccaaggaggagaagaacttcatggtggacttcctggccggcggcctctctgctgccgtgtccaagacagctgccgcgcctattgagcgtgtgaagctgctgatccagaaccaggatgagatgatcaagcagggccgcctggcttccccctacaagggcatcggcgagtgcttcgtgcgcaccgtccgcgaggagggttttggctcgctgtggcgcggcaacaccgccaacgtgattcgctacttccccacccaggccctgaacttcgctttcaaggataagttcaagcgcatgttcggcttcaacaaggacaaggagtactggaagtggttcgcgggcaacatggcctcgggcggtgctgccggcgctgtgtcgctgtcgttcgtctactcgctggactacgcccgtacccgtctggccaacgacgcgaagtcggccaagaagggtggcggagaccgccagttcaacggcctggtggacgtgtaccgcaagaccatcgcctccgacggcattgcgggcctgtaccgcggcttcaacatctcgtgcgtgggcattgttgtgtaccgcggcctgtacttcggcatgtacgactcgctgaagcccgtggtgctggtcggccccctggccaacaacttcctggcggctttcctgctgggctggggcatcaccatcggcgccggcctggcgtcctaccccatcgacaccattcgtcgtcgcatgatgatgacctcgggctccgctgtcaagtacaacagctcgttccactgcttccaggagatcgtgaagaacgagggcatgaagtcgctcttcaagggcgcgggcgccaacatcctgcgtgccgtggctggcgccggtgtgctggcgggctacgaccagctgcaggtcatcctgctgggcaagaagtacggcagcggcgaggcctaa

SEQ ID NO: 73373 - protein, 308 aa, Chlamydomonas reinhardtii
MAKEEKNFMVDFLAGGLSAAVSKTAAAPIERVKLLIQNQDEMIKQGRLASPYKGIGECFVRTVREEGFGSLWRGNTANVIRYFPTQALNFAFKDKFKRMFGFNKDKEYWKWFAGNMASGGAAGAVSLSFVYSLDYARTRLANDAKSAKKGGGDRQFNGLVDVYRKTIASDGIAGLYRGFNISCVGIVVYRGLYFGMYDSLKPVVLVGPLANNFLAAFLLGWGITIGAGLASYPIDTIRRRMMMTSGSAVKYNSSFHCFQEIVKNEGMKSLFKGAGANILRAVAGAGVLAGYDQLQVILLGKKYGSGEA

SEQ ID NO: 73374 - DNA, 927 bp, Chlamydomonas reinhardtii; identical to SEQ ID NO: 73372
  CDS (1)..(927)

SEQ ID NO: 73375 - protein, 308 aa, Chlamydomonas reinhardtii; identical to SEQ ID NO: 73373

SEQ ID NO: 73376 - DNA, 918 bp, Kluyveromyces lactis
  CDS (1)..(918)
atgtctactgacaagaaacaatccaactttgctatcgatttcttgatgggtggtgtttccgccgccgtttccaagaccgctgctgctccaattgagagagtcaagttgttgattcaaaaccaagatgaaatgatcaagcaaggttctttggacagaagatacaccggtatcgttgaatgtttcaagagaactgctgctgacgaaggtgttgcttctttctggagaggtaacactgctaacgttatcagatacttcccaactcaagccttgaactttgccttcaaggacaagatcaaggctatgttcggtttcaagaaggaagaaggttacgctaaatggttcgctggtaacttggcttctggtggtctagctggtggtttgtctctattgttcgtttactctttggattacgccagaaccagattggctgctgactccaagagcgctaagaagggtggtgaacgtcaattcaacggtctagtcgatgtctacaagaagactttggcttctgatggtgttgctggtttgtacagaggtttcttgccatctgttgttggtattgttgtctacagaggtttgtacttcggtttgtacgattctttgaaaccattgttgttgactggttctttggaaaactccttcttggcttccttcttgttgggttgggccgtcaccactggtgcttctaccgcttcttacccattggataccgttagaagaagaatgatgatgacttccggtcaagctgtcaagtatgatggtgccttcgatgctttcagaaagattgtcgctgctgaaggtatcaagtccttgttcaagggttgtggtgctaacatcttgagaggtgtcgccggtgccggtgttatctccatgtacgatcaattgcaagttatcttgttcggtaagactttcaaataa

SEQ ID NO: 73377 - protein, 305 aa, Kluyveromyces lactis
MSTDKKQSNFAIDFLMGGVSAAVSKTAAAPIERVKLLIQNQDEMIKQGSLDRRYTGIVECFKRTAADEGVASFWRGNTANVIRYFPTQALNFAFKDKIKAMFGFKKEEGYAKWFAGNLASGGLAGGLSLLFVYSLDYARTRLAADSKSAKKGGERQFNGLVDVYKKTLASDGVAGLYRGFLPSVVGIVVYRGLYFGLYDSLKPLLLTGSLENSFLASFLLGWAVTTGASTASYPLDTVRRRMMMTSGQAVKYDGAFDAFRKIVAAEGIKSLFKGCGANILRGVAGAGVISMYDQLQVILFGKTFK

SEQ ID NO: 73378 - DNA, 942 bp, Neurospora crassa
  CDS (1)..(942)
atggcggagcaacagaaggtcttgggcatgccgcccttcgtggcggacttcttgatgggtggtgtctctgccgccgtctcgaagactgctgccgctcccattgagcgtatcaagctcctcgtccagaaccaggatgagatgatccgtgccggccgtctcgaccgccgctacaacggtatcatcgactgcttcaagcgcaccaccgccgatgagggtgtcatggccttgtggcgtggcaacaccgccaacgtcatccgttacttccctacccaggccctgaacttcgctttccgtgacaagttcaagaagatgttcggctacaagaaggacgtcgatggctactggaagtggatggccggtaaccttgcctccggtggtgctgctggtgccacttccctcctcttcgtctactccctcgactacgcccgtacccgtctcgccaacgacgccaagtccgccaagaagggtggtgagcgtcagttcaacggtctcgtcgatgtctaccgcaagaccatcgcttccgatggtattgccggtctctaccgtggtttcggtccctccgtcgctggtatcgtcgtctaccgtggtctctacttcggtctctacgactccatcaagcccgtcctcctcgtcggtgacctcaagaacaacttccttgcctctttcgctctcggctggtgcgtcaccaccgccgctggtatcgcctcttaccctcttgacaccatccgtcgtcgcatgatgatgacctccggtgaggccgtcaagtacaagtcttccttcgatgccgcttcccagatcgttgccaaggagggtgtcaagtctctcttcaagggtgctggtgccaacattctccgtggtgtcgccggtgctggtgtcctctccatctacgaccagctccaggtcctcctcttcggcaaggccttcaagggtggttccggttaa

SEQ ID NO: 73379 - protein, 313 aa, Neurospora crassa
MAEQQKVLGMPPFVADFLMGGVSAAVSKTAAAPIERIKLLVQNQDEMIRAGRLDRRYNGIIDCFKRTTADEGVMALWRGNTANVIRYFPTQALNFAFRDKFKKMFGYKKDVDGYWKWMAGNLASGGAAGATSLLFVYSLDYARTRLANDAKSAKKGGERQFNGLVDVYRKTIASDGIAGLYRGFGPSVAGIVVYRGLYFGLYDSIKPVLLVGDLKNNFLASFALGWCVTTAAGIASYPLDTIRRRMMMTSGEAVKYKSSFDAASQIVAKEGVKSLFKGAGANILRGVAGAGVLSIYDQLQVLLFGKAFKGGSG

SEQ ID NO: 73380 - DNA, 1074 bp, Saccharomyces cerevisiae
  CDS (1)..(1074)
atgacgcgagatagcccagattctaacgacagctataagcatataaacaagaatactacacaaaaaacctcgtttgatagaaattcattcgattatattgtacgatcgggattagctggaggtatatcaggttcatgtgcgaaaacactaatcgcacccttagatagaataaaaattttatttcaaacatcaaatccgcactacacaaagtacacaggctcactaataggattagtagaggcagccaagcatatatggatcaatgatggggtaagggggttttttcaaggccattcagcaacccttttaaggatttttccatatgctgctgtcaaatttgttgcttatgaacagattaggaataccttgattccctcaaaagaatttgagtcacattggagaaggttggtgagtggttcactggcaggattatgcagtgttttcataacatatccgttagatctcgtgagggttaggttagcatatgaaacagaacataagagagtaaagctaggaagaataatcaagaaaatatataaggaaccagcttcagccacgctaatcaaaaatgattatattcctaactggttttgtcattggtgtaatttttataggggttatgttccaactgtacttggcatgataccatatgcaggtgtttccttttttgctcacgatttacttcatgatgtgctgaagagtcctttctttgccccttattcagtattagaactttcagaagatgatgaattggaaagagtacagaaaaagcagagaaggcctttgcgtacgtgggctgaattgatctctggtggtctagctggtatggcctcccaaacggcagcatatccatttgaaattattaggagaaggctccaagtaagtgcactgtcaccaaaaactatgtatgatcataaatttcaatcgatatctgaaattgctcacataatatttaaagaacgtggagtacgtggattttttgttggtctaagcataggttatattaaagtaacacctatggttgcatgtagttttttcgtctatgaaagaatgaaatggaattttggcatttaa

SEQ ID NO: 73381 - protein, 357 aa, Saccharomyces cerevisiae
MTRDSPDSNDSYKHINKNTTQKTSFDRNSFDYIVRSGLAGGISGSCAKTLIAPLDRIKILFQTSNPHYTKYTGSLIGLVEAAKHIWINDGVRGFFQGHSATLLRIFPYAAVKFVAYEQIRNTLIPSKEFESHWRRLVSGSLAGLCSVFITYPLDLVRVRLAYETEHKRVKLGRIIKKIYKEPASATLIKNDYIPNWFCHWCNFYRGYVPTVLGMIPYAGVSFFAHDLLHDVLKSPFFAPYSVLELSEDDELERVQKKQRRPLRTWAELISGGLAGMASQTAAYPFEIIRRRLQVSALSPKTMYDHKFQSISEIAHIIFKERGVRGFFVGLSIGYIKVTPMVACSFFVYERMKWNFGI

SEQ ID NO: 73382 - DNA, 981 bp, Schizosaccharomyces pombe
  CDS (1)..(981)
atgcctaactcaactgcccaatatccggaaaaggattcatgggaattcttagtcaaatctggaattgctggtggtacagctggatgcgttgcaaaatcagtagttgccccattagatagagtgaaaatcctttaccaaaccaatcacgcttcttatcgagggtatgcttattcacggcatgggctttataaggctatcaaacacatttaccacgtctatggcttacacggtctttatcaaggccacactgctactttatacagagtcttcccttatgcgggcattaaatttgttgcatacgaacaagtacggcgtgttttaattcgtgaccctgaacatgaaacacatgctcggcgatttttatcaggatcacttgccggaacttgctctgttttttttacatacccgttagagctgattcgtgttcgtttagcctacataaccaatacagggaagaatcctaccctaactcaagttacaaaagatatatttcacgaacgtgattttttgtgcaataagaagtatcctgggttatcccgtttgtcaaaaatctgtaatttttatcgtggattttctgttacgttaactggaatctttccatatgctggtatgtcgtttcttgcctacgatcttgcaactgatttttttcataaacaaaaaattgacgaatgggtttctacaaaaaagtcagataaaaaacttaaaacttggcccgaactactttgtggagcatttgcaggagtttgtggtcaaacggtttcttacccattcgaagtttgtcgacgaaaaatgcaaattggtggtatcagaaaaaataaatcatttcttagacttaagcaggtagtacaaactacttacaaagaagccggtatgagaggttttttcgttggacttaccataggttacattaaggttatcccaatggtaagcactagcttttttgtttacaatcacagcaaagcgcttttagggatagattga

SEQ ID NO: 73383 - protein, 326 aa, Schizosaccharomyces pombe
MPNSTAQYPEKDSWEFLVKSGIAGGTAGCVAKSVVAPLDRVKILYQTNHASYRGYAYSRHGLYKAIKHIYHVYGLHGLYQGHTATLYRVFPYAGIKFVAYEQVRRVLIRDPEHETHARRFLSGSLAGTCSVFFTYPLELIRVRLAYITNTGKNPTLTQVTKDIFHERDFLCNKKYPGLSRLSKICNFYRGFSVTLTGIFPYAGMSFLAYDLATDFFHKQKIDEWVSTKKSDKKLKTWPELLCGAFAGVCGQTVSYPFEVCRRKMQIGGIRKNKSFLRLKQVVQTTYKEAGMRGFFVGLTIGYIKVIPMVSTSFFVYNHSKALLGID

SEQ ID NO: 73384 - DNA, 23 bp, Artificial sequence
  primer
atggcagaagtactgaccgtcct

SEQ ID NO: 73385 - DNA, 26 bp, Artificial sequence
  primer
tcaccaatttcttacagaatcacata

SEQ ID NO: 73386 - protein, 479 aa, Artificial sequence
  consensus sequence
  Variant (2)..(4): Xaa in position 2 to 4 is any amino acid
  Variant (6)..(7): Xaa in position 6 to 7 is any amino acid
  Variant (8)..(9): Xaa in position 8 to 9 is any or no amino acid
  Variant (11)..(13): Xaa in position 11 to 13 is any amino acid
  Variant (15)..(22): Xaa in position 15 to 22 is any amino acid
  Variant (24)..(42): Xaa in position 24 to 42 is any amino acid
  Variant (43)..(67): Xaa in position 43 to 67 is any or no amino acid
  Variant (69)..(74): Xaa in position 69 to 74 is any amino acid
  Variant (77)..(84): Xaa in position 77 to 84 is any amino acid
  Variant (86)..(87): Xaa in position 86 to 87 is any amino acid
  Variant (89)..(115): Xaa in position 89 to 115 is any amino acid
  Variant (116)..(141): Xaa in position 116 to 141 is any or no amino acid
  Variant (143)..(144): Xaa in position 143 to 144 is any amino acid
  Variant (147)..(153): Xaa in position 147 to 153 is any amino acid
  Variant (156)..(161): Xaa in position 156 to 161 is any amino acid
  Variant (164)..(179): Xaa in position 164 to 179 is any amino acid
  Variant (180)..(246): Xaa in position 180 to 246 is any or no amino acid
  Variant (248)..(251): Xaa in position 248 to 251 is any amino acid
  Variant (253)..(253): Xaa in position 253 is any amino acid
  Variant (255)..(260): Xaa in position 255 to 260 is any amino acid
  Variant (262)..(268): Xaa in position 262 to 268 is any amino acid
  Variant (269)..(269): Xaa in position 269 is any or no amino acid
  Variant (271)..(272): Xaa in position 271 to 272 is any amino acid
  Variant (274)..(294): Xaa in position 274 to 294 is any amino acid
  Variant (295)..(340): Xaa in position 295 to 340 is any or no amino acid
  Variant (342)..(353): Xaa in position 342 to 353 is any amino acid
  Variant (354)..(364): Xaa in position 354 to 364 is any or no amino acid
  Variant (366)..(369): Xaa in position 366 to 369 is any amino acid
  Variant (371)..(373): Xaa in position 371 to 373 is any amino acid
  Variant (375)..(388): Xaa in position 375 to 388 is any amino acid
  Variant (389)..(427): Xaa in position 389 to 427 is any or no amino acid
  Variant (429)..(432): Xaa in position 429 to 432 is any amino acid
  Variant (434)..(439): Xaa in position 434 to 439 is any amino acid
  Variant (441)..(446): Xaa in position 441 to 446 is any amino acid
  Variant (447)..(466): Xaa in position 447 to 466 is any or no amino acid
  Variant (468)..(469): Xaa in position 468 to 469 is any amino acid
  Variant (471)..(477): Xaa in position 471 to 477 is any amino acid
  Variant (478)..(478): Xaa in position 478 is any or no amino acid
GXXXGXXXXTXXXPXXXXXXXXQXXXXXXXXXXXXXXXXXXXXXXXXXXXXXXXXXXXXXXXXXXXXGXXXXXXGNXXXXXXXXPXXAXXXXXXXXXXXXXXXXXXXXXXXXXXXXXXXXXXXXXXXXXXXXXXXXXXXXXGXXAGXXXXXXXYPXXXXXXRLXXXXXXXXXXXXXXXXXXXXXXXXXXXXXXXXXXXXXXXXXXXXXXXXXXXXXXXXXXXXXXXXXXXXXXXXXXXXXXXXXXXGXXXXYXGXXXXXXGXXXXXXXXFXXYXXXXXXXXXXXXXXXXXXXXXXXXXXXXXXXXXXXXXXXXXXXXXXXXXXXXXXXXXXXXXXXXXXXGXXXXXXXXXXXXXXXXXXXXXXXPXXXXRXXXQXXXXXXXXXXXXXXXXXXXXXXXXXXXXXXXXXXXXXXXXXXXXXXXXXXXXXIXXXXGXXXXXXGXXXXXXXXXXXXXXXXXXXXXXXXXXKXXPXXXXXXXXY

SEQ ID NO: 73387 - protein, 24 aa, Artificial sequence
  protein pattern
  Variant (2)..(9): Xaa in position 2 to 9 is any amino acid
  Variant (11)..(12): Xaa in position 11 to 12 is any amino acid
  Variant (13)..(13): Xaa in position 13 is Ala or Ser
  Variant (15)..(16): Xaa in position 15 to 16 is any amino acid
  Variant (17)..(20): Xaa in position 17 to 20 is any or no amino acid
  Variant (22)..(23): Xaa in position 22 to 23 is any amino acid
  Variant (24)..(24): Xaa in position 24 is Ile, Leu or Val
GXXXXXXXXTXXXPXXXXXXRXXX

SEQ ID NO: 73388 - protein, 23 aa, Artificial sequence
  protein pattern
  Variant (2)..(2): Xaa in position 2 is any amino acid
  Variant (3)..(5): Xaa in position 3 to 5 is any or no amino acid
  Variant (7)..(7): Xaa in position 7 is any amino acid
  Variant (8)..(8): Xaa in position 8 is any or no amino acid
  Variant (10)..(12): Xaa in position 10 to 12 is any amino acid
  Variant (13)..(13): Xaa in position 13 is Ala, Asn, Ser or Thr
  Variant (14)..(18): Xaa in position 14 to 18 is any amino acid
  Variant (20)..(21): Xaa in position 20 to 21 is any amino acid
  Variant (22)..(22): Xaa in position 22 is Ala or Ser
  Variant (23)..(23): Xaa in position 23 is Ile, Leu, Met or Val
GXXXXFXXGXXXXXXXXXPXXXX

SEQ ID NO: 73389 - DNA, 2709 bp, Saccharomyces cerevisiae
  CDS (1)..(2709)
atggagcaaatcaattcgaacagtagaaaaaagaagcaacaattggaagtattcaaatattttgcaagtgtccttacaaaagaggacaagcctattagtatcagtaatggtatgttagatatgccgacagtgaactccagtaaactcacagcaggaaatgggaaacctgacacggagaagcttacaggagaactaattttaacatacgacgatttcattgaactgatatctagctcaaagactatttattcgaagtttacggaccattcgttcaatttgaaccagatacccaagaacgttttcgggtgtattttcttcgctattgatgaacaaaacaagggatatctgacgcttaatgattggttttattttaataatttattagaatatgataattatcatctcattattctatatgagttctttaggaaatttgatgtagagaatttgaaggcaaaacaaaaaaaagagcttggtagttcgtcgtttaatttaaaggctgcagatgatcgaattaagtcaattaattatggtaacagatttctaagctttgatgatcttcttttgaatctgaaccaattcaaagatactatccgcctgttgcacgaatctattgatgataattttgttaaagataacaaattactacttgattggaatgactttcgatttctgaaattttacaaatgttatcatgaaaatgaagagtatttgagtttaaactctctggtcacgattttacaaaatgatcttaagaatgaaaaaatatttataggttttgataggttggcacagatggactcacaagggcatcgtttagccctaagcaaaaatcaactcacctatcttctaaggttattttactctcacagggtgtctgcagatatattttcctccttgaatctatcaaacaccgaattactaaaagcggacaataattccattccgtacaatgtattcaaggatatattttatttatttcaaaattttgacctactgaaccaaatatttcacaagtatgttactgaaaataatttgaatgagcaggatattagggaacaaatagttactaaaaatgactttatgacagttttaaacgcccagtataacaaagtaaacaatatcattgagttctctccttcccaaatcaacctactattttctatcgtcgcaaattcaaaggaaaacagaagattaagaaagagaaatcaagatcgagatgacgagctattaaatgatcaccattatgattcagatattgatttttttatccataatgagtatttgcatggagtaagcagatccagaaaaaatttagaaagttttaatgactattatcatgatctctcggatggatttgaccaagactctggtgttaaaaaagcttcaaaagcgagtactggcttgtttgaatctgtatttggaggtaaaaaagataaagcaacgatgcgttctgacttaacaattgaagatttcatgaaaattttgaacccaaattacctgaacgacttagttcaccaaatggaattgcaaaaaaatcaaaatgagtcattgtatattaattactacttttatccaattttcgattcgttgtacaatttctccttgggttctattgcgggttgtattggtgcaactgtagtatacccaatagactttataaaaacaaggatgcaagcccaaagatctttagcccaatacaaaaactcaattgattgtttgttgaagattatatcccgcgaaggaataaaaggtctctactctggcttagggccacaattaataggagttgctcctgaaaaggcgataaaattgactgtcaatgattttatgagaaacaggttgactgataaaaacggcaagctaagcctttttcctgaaattatttctggcgcttcagctggtgcatgtcaagttatatttactaatccgttagagattgtaaaaattaggctacaggtccaatccgactatgttggtgaaaacatacaacaagccaatgaaactgccactcaaatagtcaaaaaattaggactgaggggcttgtacaatggtgtagccgcatgtttaatgagagatgttccattctctgctatttattttcccacttatgcacatttaaaaaaagatctctttgattttgatccaaatgataaaacaaagaggaatcgattaaaaacatgggagcttttaactgccggtgccattgctggtatgccagctgccttcttgactactccttttgatgttataaaaacaaggctccagatagatcctcgaaaaggtgagacaaagtataacggtatatttcatgctatccgaactatcttaaaggaagagagctttagaagctttttcaaaggtggtggagcccgtgtcctaagaagttctccccaatttgggttcactctggccgcctatgaattattcaagggctttattccctcccccgataacaaattaaaaagcagagagggtaggaagagattttgtatcgatgacgacgcaggcaatgaagagacagtagttcatagtaacggtgaactcccacagcaaaagttttactctgatgatagaaaacatgccaattattactataaaagctgtcaaattgcgaaaacattcattgatttggacaataacttttctaggtttgactcttcagtttataaaaactttcaagagcacctaagaagcattaacgggtga

SEQ ID NO: 73390 - protein, 902 aa, Saccharomyces cerevisiae
MEQINSNSRKKKQQLEVFKYFASVLTKEDKPISISNGMLDMPTVNSSKLTAGNGKPDTEKLTGELILTYDDFIELISSSKTIYSKFTDHSFNLNQIPKNVFGCIFFAIDEQNKGYLTLNDWFYFNNLLEYDNYHLIILYEFFRKFDVENLKAKQKKELGSSSFNLKAADDRIKSINYGNRFLSFDDLLLNLNQFKDTIRLLHESIDDNFVKDNKLLLDWNDFRFLKFYKCYHENEEYLSLNSLVTILQNDLKNEKIFIGFDRLAQMDSQGHRLALSKNQLTYLLRLFYSHRVSADIFSSLNLSNTELLKADNNSIPYNVFKDIFYLFQNFDLLNQIFHKYVTENNLNEQDIREQIVTKNDFMTVLNAQYNKVNNIIEFSPSQINLLFSIVANSKENRRLRKRNQDRDDELLNDHHYDSDIDFFIHNEYLHGVSRSRKNLESFNDYYHDLSDGFDQDSGVKKASKASTGLFESVFGGKKDKATMRSDLTIEDFMKILNPNYLNDLVHQMELQKNQNESLYINYYFYPIFDSLYNFSLGSIAGCIGATVVYPIDFIKTRMQAQRSLAQYKNSIDCLLKIISREGIKGLYSGLGPQLIGVAPEKAIKLTVNDFMRNRLTDKNGKLSLFPEIISGASAGACQVIFTNPLEIVKIRLQVQSDYVGENIQQANETATQIVKKLGLRGLYNGVAACLMRDVPFSAIYFPTYAHLKKDLFDFDPNDKTKRNRLKTWELLTAGAIAGMPAAFLTTPFDVIKTRLQIDPRKGETKYNGIFHAIRTILKEESFRSFFKGGGARVLRSSPQFGFTLAAYELFKGFIPSPDNKLKSREGRKRFCIDDDAGNEETVVHSNGELPQQKFYSDDRKHANYYYKSCQIAKTFIDLDNNFSRFDSSVYKNFQEHLRSING

SEQ ID NO: 73391 - DNA, 2739 bp, Eremothecium gossypii
  CDS (1)..(2739)
atgatggaattgtctagcgcgagtactgtaaagaagaaacgacagttggccatattcaatgcctacgccacgcctctgcgacaagacgaaagacggctgcgggcgtcttatgagcacgggggggttgttgggggccacgtagccagtaatgagaaggttttgttgttcgacgactttgtggacctcatctcgaactcacggtcgttctattcgaagttcacggatcactgctttaacctgaaccagataccgaacacagtgttcgggtgcattttctttgcaatcgatgagaataacaagggctacctcaatgtgaacgactggttctacttcaacaacgtgctagaatatgacaactaccactttatcatcctgtatgagttttttcggaaatttgacgctgcacgggagcgcgcttacggcccctcggtcaagtcaatcaactacggtaaccgctttctttcgttcgacgagctctacttggacctagagcagttccaagccactctgcggctactgcacagctgtgtacgcgacgattttatcgttaacaacaagctgtttctcgactggaagcagttccgttggctcaaatggtaccagttctacccgcggggcctattgcagaacggaccccacatcaccttgaactcgctgatatcaatagtgcagaatgacctgaagtcggaaaagctgctgctgggcttccactgtttatcgcagctggaccaccgtaccaactctatgactatcagcaagaatcagcttgtctatctcatgcggctcttttactcgcacaaaatcccagcggatatattcaactcgctgaacatgtcgacccttagctgcgctaaatgtgataacaaccacatcaattacaacgtctttcgagacttgttctacctgatacaaaactttgatcttctcaaccaaattgtccaccggtacgcggaagttcataaattcagtgatcgtgatgttcgggagcagcatatcagcaggaaggatctgttgaggtttatgaacacggagtacaataagatcaacaacattattgagttctcgcccgcgcagatatccctcctcttctctattgtaactaactctaaaaagctaaactacttgaacaacgcacggcagaataatcctgagctttcataccatcatagagattcggagatagacagcttcatccacaacgagtacataaatgggaatgctgcatcttcgttgcataatgaaagccttgaaaaattcaacgatgacttcgagaatatcatacaagcagatgctggtgatactaaacagcagatatcatctaccgactggcgaagtgtgttctcatggagctcttttctctctagttttgagtggttacatttcaaaaagcggaaatcagtccagactaatgggctgtcagacgagtatgttaacgaagccttgaccttggaagatataatgaagatcgtcaatccgaactaccttaacgacttggttcatcacatggagctgcggcgcattgagagtgaatcacggagctcgaacttatatttctacccgatattcgattctatctataacttcacgttgggttcggtagcgggatgcataggtgctatggttgtatatccaatcgatatggtgaagacacgaatgcaagcccagagagacttctcgaagtataaaaattcgatcgactgccttcttaaaatactatcgaaggaaggcgttagaggattgtattctggattggggcctcagttaatcggcgtcgcacctgaaaaggctatcaagctaacggtaaatgatcatatgcgtgcaactcttgctggtagggacgggaagctgtctcttccctgtgagataatctctggagctacagcgggtgcctgccaggtcgttttcacaaatcccttagagattgtaaagatcaggcttcaggttaagtccgactatgttgccgacgcagcccgtaatagcgtcaatgcaatatcggtgatcaaaaacctcggacttattggtttataccggggagccggcgcctgcttattaagagatattcctttctctgcaatatatttccccacctatgctcacattaaaagtaatgttttcaactttgaccccaaggattctgacaaacgcaataagctcaatacgtggcagttacttgtatccggtggtctagcagggatgccggcggcattcttgactacacctttcgatgttatcaaaacaaggttacagattgatccaaagaaaggtgaatctgtctacaacggaatatgggatgccgcgagaaccatattgaaagaggaaggaatcaagagctttttcaaaggagggcctgccagagttttaagatcctcaccacagtttgggtttacactggccgcctacgaaatatttcacaatctcttcccagcgcctaggtacgatgattctacgactcacagaccgactagagagccggttggcgctcttgctccaataaacaaaacagtcagtgcgtttttccccgatcaactagagcctcatgtgggcaataataagtgggcctctcgcctttatggtccaaacatcgatccatatagcagcagcttcctgaattattactacaaaagttgccaggtagcgaaggcgttcatggatctggattacaactttgcccacttcgatttcaacacataccagcagttccatgatgaattaaacgcaatgaagaataaaaagcactga

SEQ ID NO: 73392 - protein, 912 aa, Eremothecium gossypii
MMELSSASTVKKKRQLAIFNAYATPLRQDERRLRASYEHGGVVGGHVASNEKVLLFDDFVDLISNSRSFYSKFTDHCFNLNQIPNTVFGCIFFAIDENNKGYLNVNDWFYFNNVLEYDNYHFIILYEFFRKFDAARERAYGPSVKSINYGNRFLSFDELYLDLEQFQATLRLLHSCVRDDFIVNNKLFLDWKQFRWLKWYQFYPRGLLQNGPHITLNSLISIVQNDLKSEKLLLGFHCLSQLDHRTNSMTISKNQLVYLMRLFYSHKIPADIFNSLNMSTLSCAKCDNNHINYNVFRDLFYLIQNFDLLNQIVHRYAEVHKFSDRDVREQHISRKDLLRFMNTEYNKINNIIEFSPAQISLLFSIVTNSKKLNYLNNARQNNPELSYHHRDSEIDSFIHNEYINGNAASSLHNESLEKFNDDFENIIQADAGDTKQQISSTDWRSVFSWSSFLSSFEWLHFKKRKSVQTNGLSDEYVNEALTLEDIMKIVNPNYLNDLVHHMELRRIESESRSSNLYFYPIFDSIYNFTLGSVAGCIGAMVVYPIDMVKTRMQAQRDFSKYKNSIDCLLKILSKEGVRGLYSGLGPQLIGVAPEKAIKLTVNDHMRATLAGRDGKLSLPCEIISGATAGACQVVFTNPLEIVKIRLQVKSDYVADAARNSVNAISVIKNLGLIGLYRGAGACLLRDIPFSAIYFPTYAHIKSNVFNFDPKDSDKRNKLNTWQLLVSGGLAGMPAAFLTTPFDVIKTRLQIDPKKGESVYNGIWDAARTILKEEGIKSFFKGGPARVLRSSPQFGFTLAAYEIFHNLFPAPRYDDSTTHRPTREPVGALAPINKTVSAFFPDQLEPHVGNNKWASRLYGPNIDPYSSSFLNYYYKSCQVAKAFMDLDYNFAHFDFNTYQQFHDELNAMKNKKH

SEQ ID NO: 73393 - DNA, 2760 bp, Candida glabrata CBS 138
  CDS (1)..(2760)
atggagcagttaaactcgaatggtcgaaagaaattggagcaagttgctatatttaaacgatttgcttcgacaatagatgatacacaggatgacaagacagccagtattctttctttcctaaagtcctctcacggtgacaatgggattggtgcaaggactactgtagaacgcactgggcataaaagtaccggagaaatggtgttgatgtatgatgattttgttcgtcttatatctaattcacagcagttttattcgaaattcagcgggcatacattcaatctgaaccaagtaccagctaacacatttggttgtatattctttgcaatggatgagaataataagggttatttaacaataagcgattggtttcaactaaacaacatactggagcatgaaaattaccatctaataatactgtatgagttcttcagaaagtttgacgtggagaagactaatgcccaattgagaaagtcagtctttggggggagcaaatacagaaagcagaatacacttcaccactctcccgactctggctatggagaaagactgccattcaatacaaagtccattaattatgcaaataagttcttgagttttgatgagcttctcctcaatttggatcaatttaaagaaacaatatccttattacagaactgcattaaaaatgacgattttgtacagaagaatgacctaattcttcattgggacaagtttgattttttgaagttataccaatgcttccattatggaaagccatatttgactcttaactcattagtgacaatactacagaatgatttaaagtatgaaaaaatgattacagggttcagacatttagcccaatttgatgcatccagacacagattatctttgaataaaaatcaactagtctacttgttgaaattattctactcccataaagtttctgcagatatatttgagtctctgaatctttctaacacaaaactaatcaaatcggataataactcaattgcatttaatgtctacagagacattttctatttatttcaaaattttgatttactaaatcaagtttttttaaaatatgctgaagataataacatgagtgaccgtgatattagagagcaagtaatcaccaagaaaaacctaatggattttttaaacaagcagtataataaggtcaccaatataagtgaattctcgccatctcaaataaatctattattctctattgttgctaattcaaaagaatataatagacatcgtacgcgcttaatccaaaattcacaggaattgaaccatgaagattcagaaattaatcattttattcataatgaatttatgcacggggggagaaataagaaggaagagttagaaacattcaatgataactataaggatatcgctaatggttttgctcaagactcgaatattaaaagtatttctaaaacaagcacaggttggtttgaacgagtgtttggtggacggagtgacattgcaactatgcgttcagatcttacagttcaggactttttgaagattttgaacccaaactatttgaatgatgttgttcatagattggaacttcgccatattgaagaggagtctctttacaccaactattatttctacccaatatttgattcgctgtataacttctcactaggctctgttgcaggatgtattggagctactattgtttatccaattgattttgttaaaacaaggatgcaagcccaaagatctctatcgcaatacaagaactccattgattgtttcttgaagatactgtcaagagaaggtataagaggtgtttattcgggattgggacctcagctgataggagttgcacctgaaaaggcgatcaaactgactgtaaatgattatatgcgtaataaactgaaagacaagaacggtaaacttggtctactgtcagaaattatttctggtgcttctgctggtgcttgccaagtgatatttactaacccgcttgagattgttaagattagattacaagtcaaaggtgaatatgtggccgaaaacgcggagaatgcaaaattgactgcattgcaaattatcaaaagactgggcttgccaggtttatacaaaggagctgccgcttgtttgttgagagatgttccattttcggcgatatatttcccaacctatgcccatctaaaaagggatctgttcaattttgatcctaatgacaaaaataaaagatcgcgtctaaacacctgggaacttctttctgcaggtgctttagccggcatgccagctgcgtatctgacaacaccattcgacgtgatcaagacacgtttacaaattgatccaaagaaaggtgagactatatacaagggtattattcatgcagcgcgtactattttgagggaagaaagttttaagagcttttttaaaggtggtgctgccagagtgctaagaagttcaccacagtttgggtttactttagctgcgtatgagctgttccacaatatattcccattaccaaatgacaaggacaaatttgttatatcagaagatgatagaagagctaagattctcaacaataacgctcgtggaccgaatattgataagagagagttgaccagaatagtagaaaatccgtacagtgacagctacctcaattactactataagagctgtcaagttgcgaagacattcatagaactagacaacaattttgctaagtttgactatggtacatacttgaaatttcacgagcatttgagagctatatcgagaggtgaagacccttga

SEQ ID NO: 73394 - protein, 919 aa, Candida glabrata CBS 138
MEQLNSNGRKKLEQVAIFKRFASTIDDTQDDKTASILSFLKSSHGDNGIGARTTVERTGHKSTGEMVLMYDDFVRLISNSQQFYSKFSGHTFNLNQVPANTFGCIFFAMDENNKGYLTISDWFQLNNILEHENYHLIILYEFFRKFDVEKTNAQLRKSVFGGSKYRKQNTLHHSPDSGYGERLPFNTKSINYANKFLSFDELLLNLDQFKETISLLQNCIKNDDFVQKNDLILHWDKFDFLKLYQCFHYGKPYLTLNSLVTILQNDLKYEKMITGFRHLAQFDASRHRLSLNKNQLVYLLKLFYSHKVSADIFESLNLSNTKLIKSDNNSIAFNVYRDIFYLFQNFDLLNQVFLKYAEDNNMSDRDIREQVITKKNLMDFLNKQYNKVTNISEFSPSQINLLFSIVANSKEYNRHRTRLIQNSQELNHEDSEINHFIHNEFMHGGRNKKEELETFNDNYKDIANGFAQDSNIKSISKTSTGWFERVFGGRSDIATMRSDLTVQDFLKILNPNYLNDVVHRLELRHIEEESLYTNYYFYPIFDSLYNFSLGSVAGCIGATIVYPIDFVKTRMQAQRSLSQYKNSIDCFLKILSREGIRGVYSGLGPQLIGVAPEKAIKLTVNDYMRNKLKDKNGKLGLLSEIISGASAGACQVIFTNPLEIVKIRLQVKGEYVAENAENAKLTALQIIKRLGLPGLYKGAAACLLRDVPFSAIYFPTYAHLKRDLFNFDPNDKNKRSRLNTWELLSAGALAGMPAAYLTTPFDVIKTRLQIDPKKGETIYKGIIHAARTILREESFKSFFKGGAARVLRSSPQFGFTLAAYELFHNIFPLPNDKDKFVISEDDRRAKILNNNARGPNIDKRELTRIVENPYSDSYLNYYYKSCQVAKTFIELDNNFAKFDYGTYLKFHEHLRAISRGEDP

SEQ ID NO: 73395 - DNA, 2721 bp, Kluyveromyces lactis NRRL Y-1140
  CDS (1)..(2721)
atggaactagtgaattcgaatagcgagaaaaagaagcagcagctggaggtgtttagcaaatatgccagtgtgcttactgctgagcagaaaaagctgggagaaccgtatgctagcgatgtttcggactccggagagactggtgagtcggtgttaaggtacgatgatttcatcaggcttatatcgaactcgcagtcgttgtactcgaagtttactgatcactcgttcaatttgaatcagatcccgaagaatgtatttggatgtatctttttcgccatggatgaacagaataaaggatatttaaccatcaacgattggttccatttcaacaacatcttggagttcaacaactaccatttgattgtattatatgagtttttcaggaagtttgatgtggcaaggatacgggcccgacaaacttcgaatatcgatgatcaacgtgtgaaatatatcaattatgggaataagttcctgagttttgatgagctgtatttgaacgtcgatcagtttaagtccactatttcgttcttacaaaaatgcgttaacgatgaatttattatgaaaaatgatttggctttgaattggaacgaatttcgttggttcccattttaccagtgtagtccgtttgggaaatcttcaggcacttatttctctttgaattcgctcgtcacgattttgcaaagcgatttgaaagatgagaaaatgttcgttgggttcaataaattatgccatctgaacccatcgaaaaattgtcggacgctttccaagaaccagctatcttaccttttgaaattgttctattctcacagagtctcttcagatgttttcaattctttggatttatccaacacaaagcttatcaaatgcgataacaattatatccaatacaatgtcataaaagacatattttatttatttgagaattttgatcttttgaaccaggtgcttatacgttacgcacaatattacgaattcgatgagaacgatgtcagagagcaagtgattacgaagagggactttatggagtttttgaataaagagtataacaaagtgacgaatattgtagagttttccccatcacagattaacctcttgttctccattgtatcaaactcaaaacagtcaaggcaccaatgtttgacttcgatgcaccactctgatgaaaccatcgacgatttcattcatagccaagttcagatgggacctcatattaataaggggactattaaagagttcaacgaaaactataactcaactgtggatgaatttagccaggcttcttcgttacaagaacataacgaaaggaagcaaagccaaagagtctcattattggatcgtctttgggcaagtaagactccaaaggatactgccgagagtcgtaaccttactatggaagactttatgaaaatcttgaaccctaactatttgaacgatattgtgcattccatggagttgaagagaattagatcggaatcatggtactctaacttctatttctacccgatctttgattcgattcataactttacgttaggctccatagctgggtgcatcggcgccactgtcgtgtaccctattgacctggtaaagacaagaatgcaagcgcaacgtaacagtgtacagtacaaaaactccattgattgtgttgtgaaaatcttccaaactaagggtattagaggtctttactctggtctaggcccacagttaatcggtgtagcccccgaaaaagctatcaaattgacagtgaacgatttcatgagacagtatttcatgaacaagtctcgtacgattaaatggtaccaagaaatcctttcaggcgccaccgctggtgcttgccaagttgtgtttacaaatccattggaaatcgtaaagatcagattacaaatgagatcagattacgtcggtgaaaatgcaaggccacaattaggtgcagtaggaattataaggcaattgggccttcgcggtctctacaaaggtgccgcagcatgcttactgagagacgtcccattctccgccatatatttcccaacatatgctcatttaaagaaggatgtatttaattttgatccaaatgataaaaacaagagaaacaaactcaaaacctgggaactcctcttggctggtgggatcgcaggtatgccagcagcttatttgaccactccttttgatgtgattaagaccagattacaaatcgatcccaggaagggagaaacaacgtatacaggtgtaatccatgcagcaagaacgatcttgaaagaggaaagcatcaaatcatttttcaaaggtggaccggctcgtgtgttgagaagttccccacagttcggtttcaccttggcagcatttgaaatgttccaagggttattcccatcgcatttcaagaaccatgaaacaaacagtaacaacgacagcaacaataactcaagctcttttggcggacccaaaaagcattccgacgtagaggatgatacacccatcgtcactggtttgttcacaaccttctacaaaaatttcaaaaataatcattacagccatgaaccagttccgatagaattctatggtccatcagtggacccatactccagtaatttcctcaattactactacaagagctgtcaaatatcaaaagttttcatagacctcgattacaactttgccaagttcgattttaatgtttacagaaagttccaagatgaattgaaacgaattggccctaagagcaactaa

SEQ ID NO: 73396 - protein, 906 aa, Kluyveromyces lactis NRRL Y-1140
MELVNSNSEKKKQQLEVFSKYASVLTAEQKKLGEPYASDVSDSGETGESVLRYDDFIRLISNSQSLYSKFTDHSFNLNQIPKNVFGCIFFAMDEQNKGYLTINDWFHFNNILEFNNYHLIVLYEFFRKFDVARIRARQTSNIDDQRVKYINYGNKFLSFDELYLNVDQFKSTISFLQKCVNDEFIMKNDLALNWNEFRWFPFYQCSPFGKSSGTYFSLNSLVTILQSDLKDEKMFVGFNKLCHLNPSKNCRTLSKNQLSYLLKLFYSHRVSSDVFNSLDLSNTKLIKCDNNYIQYNVIKDIFYLFENFDLLNQVLIRYAQYYEFDENDVREQVITKRDFMEFLNKEYNKVTNIVEFSPSQINLLFSIVSNSKQSRHQCLTSMHHSDETIDDFIHSQVQMGPHINKGTIKEFNENYNSTVDEFSQASSLQEHNERKQSQRVSLLDRLWASKTPKDTAESRNLTMEDFMKILNPNYLNDIVHSMELKRIRSESWYSNFYFYPIFDSIHNFTLGSIAGCIGATVVYPIDLVKTRMQAQRNSVQYKNSIDCVVKIFQTKGIRGLYSGLGPQLIGVAPEKAIKLTVNDFMRQYFMNKSRTIKWYQEILSGATAGACQVVFTNPLEIVKIRLQMRSDYVGENARPQLGAVGIIRQLGLRGLYKGAAACLLRDVPFSAIYFPTYAHLKKDVFNFDPNDKNKRNKLKTWELLLAGGIAGMPAAYLTTPFDVIKTRLQIDPRKGETTYTGVIHAARTILKEESIKSFFKGGPARVLRSSPQFGFTLAAFEMFQGLFPSHFKNHETNSNNDSNNNSSSFGGPKKHSDVEDDTPIVTGLFTTFYKNFKNNHYSHEPVPIEFYGPSVDPYSSNFLNYYYKSCQISKVFIDLDYNFAKFDFNVYRKFQDELKRIGPKSN

SEQ ID NO: 73397 - DNA, 25 bp, Artificial sequence
  primer
atggagcaaatcaattcgaacagta

SEQ ID NO: 73398 - DNA, 24 bp, Artificial sequence
  primer
tcacccgttaatgcttcttaggtg

SEQ ID NO: 73399 - protein, 965 aa, Artificial sequence
  consensus sequence
  Variant (3)..(9): Xaa in position 3 to 9 is any amino acid
  Variant (12)..(13): Xaa in position 12 to 13 is any amino acid
  Variant (15)..(17): Xaa in position 15 to 17 is any amino acid
  Variant (19)..(21): Xaa in position 19 to 21 is any amino acid
  Variant (23)..(47): Xaa in position 23 to 47 is any amino acid
  Variant (48)..(64): Xaa in position 48 to 64 is any or no amino acid
  Variant (66)..(67): Xaa in position 66 to 67 is any amino acid
  Variant (69)..(70): Xaa in position 69 to 70 is any amino acid
  Variant (74)..(75): Xaa in position 74 to 75 is any amino acid
  Variant (79)..(79): Xaa in position 79 is any amino acid
  Variant (81)..(83): Xaa in position 81 to 83 is any amino acid
  Variant (88)..(89): Xaa in position 88 to 89 is any amino acid
  Variant (91)..(91): Xaa in position 91 is any amino acid
  Variant (97)..(97): Xaa in position 97 is any amino acid
  Variant (99)..(101): Xaa in position 99 to 101 is any amino acid
  Variant (109)..(109): Xaa in position 109 is any amino acid
  Variant (112)..(112): Xaa in position 112 is any amino acid
  Variant (118)..(120): Xaa in position 118 to 120 is any amino acid
  Variant (124)..(125): Xaa in position 124 to 125 is any amino acid
  Variant (128)..(128): Xaa in position 128 is any amino acid
  Variant (131)..(132): Xaa in position 131 to 132 is any amino acid
  Variant (136)..(136): Xaa in position 136 is any amino acid
  Variant (138)..(138): Xaa in position 138 is any amino acid
  Variant (148)..(152): Xaa in position 148 to 152 is any amino acid
  Variant (154)..(158): Xaa in position 154 to 158 is any amino acid
  Variant (159)..(187): Xaa in position 159 to 187 is any or no amino acid
  Variant (189)..(189): Xaa in position 189 is any amino acid
  Variant (193)..(193): Xaa in position 193 is any amino acid
  Variant (195)..(195): Xaa in position 195 is any amino acid
  Variant (201)..(201): Xaa in position 201 is any amino acid
  Variant (203)..(203): Xaa in position 203 is any amino acid
  Variant (205)..(207): Xaa in position 205 to 207 is any amino acid
  Variant (210)..(211): Xaa in position 210 to 211 is any amino acid
  Variant (213)..(215): Xaa in position 213 to 215 is any amino acid
  Variant (217)..(221): Xaa in position 217 to 221 is any amino acid
  Variant (222)..(222): Xaa in position 222 is any or no amino acid
  Variant (224)..(224): Xaa in position 224 is any amino acid
  Variant (226)..(228): Xaa in position 226 to 228 is any amino acid
  Variant (230)..(230): Xaa in position 230 is any amino acid
  Variant (232)..(232): Xaa in position 232 is any amino acid
  Variant (234)..(234): Xaa in position 234 is any amino acid
  Variant (236)..(237): Xaa in position 236 to 237 is any amino acid
  Variant (239)..(243): Xaa in position 239 to 243 is any amino acid
  Variant (245)..(255): Xaa in position 245 to 255 is any amino acid
  Variant (256)..(259): Xaa in position 256 to 259 is any or no amino acid
  Variant (264)..(265): Xaa in position 264 to 265 is any amino acid
  Variant (267)..(267): Xaa in position 267 is any amino acid
  Variant (269)..(269): Xaa in position 269 is any amino acid
  Variant (273)..(273): Xaa in position 273 is any amino acid
  Variant (276)..(278): Xaa in position 276 to 278 is any amino acid
  Variant (281)..(282): Xaa in position 281 to 282 is any amino acid
  Variant (284)..(296): Xaa in position 284 to 296 is any amino acid
  Variant (301)..(301): Xaa in position 301 is any amino acid
  Variant (304)..(305): Xaa in position 304 to 305 is any amino acid
  Variant (311)..(314): Xaa in position 311 to 314 is any amino acid
  Variant (316)..(316): Xaa in position 316 is any amino acid
  Variant (318)..(318): Xaa in position 318 is any amino acid
  Variant (321)..(322): Xaa in position 321 to 322 is any amino acid
  Variant (324)..(328): Xaa in position 324 to 328 is any amino acid
  Variant (330)..(330): Xaa in position 330 is any amino acid
  Variant (334)..(334): Xaa in position 334 is any amino acid
  Variant (336)..(337): Xaa in position 336 to 337 is any amino acid
  Variant (340)..(341): Xaa in position 340 to 341 is any amino acid
  Variant (343)..(343): Xaa in position 343 is any amino acid
  Variant (347)..(348): Xaa in position 347 to 348 is any amino acid
  Variant (356)..(359): Xaa in position 356 to 359 is any amino acid
  Variant (361)..(369): Xaa in position 361 to 369 is any amino acid
  Variant (371)..(371): Xaa in position 371 is any amino acid
  Variant (375)..(385): Xaa in position 375 to 385 is any amino acid
  Variant (387)..(388): Xaa in position 387 to 388 is any amino acid
  Variant (392)..(393): Xaa in position 392 to 393 is any amino acid
  Variant (396)..(396): Xaa in position 396 is any amino acid
  Variant (401)..(401): Xaa in position 401 is any amino acid
  Variant (404)..(404): Xaa in position 404 is any amino acid
  Variant (411)..(411): Xaa in position 411 is any amino acid
  Variant (415)..(425): Xaa in position 415 to 425 is any amino acid
  Variant (426)..(434): Xaa in position 426 to 434 is any or no amino acid
  Variant (436)..(436): Xaa in position 436 is any amino acid
  Variant (438)..(439): Xaa in position 438 to 439 is any amino acid
  Variant (441)..(442): Xaa in position 441 to 442 is any amino acid
  Variant (446)..(450): Xaa in position 446 to 450 is any amino acid
  Variant (452)..(461): Xaa in position 452 to 461 is any amino acid
  Variant (462)..(464): Xaa in position 462 to 464 is any or no amino acid
  Variant (467)..(477): Xaa in position 467 to 477 is any amino acid
  Variant (478)..(482): Xaa in position 478 to 482 is any or no amino acid
  Variant (484)..(484): Xaa in position 484 is any amino acid
  Variant (486)..(514): Xaa in position 486 to 514 is any amino acid
  Variant (515)..(526): Xaa in position 515 to 526 is any or no amino acid
  Variant (529)..(530): Xaa in position 529 to 530 is any amino acid
  Variant (532)..(533): Xaa in position 532 to 533 is any amino acid
  Variant (536)..(536): Xaa in position 536 is any amino acid
  Variant (544)..(544): Xaa in position 544 is any amino acid
  Variant (547)..(548): Xaa in position 547 to 548 is any amino acid
  Variant (551)..(555): Xaa in position 551 to 555 is any amino acid
  Variant (558)..(560): Xaa in position 558 to 560 is any amino acid
  Variant (562)..(562): Xaa in position 562 is any amino acid
  Variant (571)..(572): Xaa in position 571 to 572 is any amino acid
  Variant (575)..(575): Xaa in position 575 is any amino acid
  Variant (579)..(579): Xaa in position 579 is any amino acid
  Variant (586)..(587): Xaa in position 586 to 587 is any amino acid
  Variant (593)..(594): Xaa in position 593 to 594 is any amino acid
  Variant (603)..(606): Xaa in position 603 to 606 is any amino acid
  Variant (614)..(615): Xaa in position 614 to 615 is any amino acid
  Variant (618)..(621): Xaa in position 618 to 621 is any amino acid
  Variant (623)..(624): Xaa in position 623 to 624 is any amino acid
  Variant (626)..(626): Xaa in position 626 is any amino acid
  Variant (650)..(650): Xaa in position 650 is any amino acid
  Variant (653)..(666): Xaa in position 653 to 666 is any amino acid
  Variant (669)..(669): Xaa in position 669 is any amino acid
  Variant (673)..(673): Xaa in position 673 is any amino acid
  Variant (680)..(680): Xaa in position 680 is any amino acid
  Variant (694)..(697): Xaa in position 694 to 697 is any amino acid
  Variant (700)..(708): Xaa in position 700 to 708 is any amino acid
  Variant (709)..(709): Xaa in position 709 is any or no amino acid
  Variant (711)..(716): Xaa in position 711 to 716 is any amino acid
  Variant (720)..(720): Xaa in position 720 is any amino acid
  Variant (724)..(724): Xaa in position 724 is any amino acid
  Variant (726)..(727): Xaa in position 726 to 727 is any amino acid
  Variant (731)..(731): Xaa in position 731 is any amino acid
  Variant (734)..(734): Xaa in position 734 is any amino acid
  Variant (747)..(747): Xaa in position 747 is any amino acid
  Variant (749)..(751): Xaa in position 749 to 751 is any amino acid
  Variant (753)..(753): Xaa in position 753 is any amino acid
  Variant (757)..(757): Xaa in position 757 is any amino acid
  Variant (759)..(760): Xaa in position 759 to 760 is any amino acid
  Variant (763)..(764): Xaa in position 763 to 764 is any amino acid
  Variant (766)..(766): Xaa in position 766 is any amino acid
  Variant (769)..(769): Xaa in position 769 is any amino acid
  Variant (772)..(773): Xaa in position 772 to 773 is any amino acid
  Variant (775)..(776): Xaa in position 775 to 776 is any amino acid
  Variant (783)..(783): Xaa in position 783 is any amino acid
  Variant (800)..(800): Xaa in position 800 is any amino acid
  Variant (804)..(805): Xaa in position 804 to 805 is any amino acid
  Variant (807)..(807): Xaa in position 807 is any amino acid
  Variant (809)..(811): Xaa in position 809 to 811 is any amino acid
  Variant (813)..(813): Xaa in position 813 is any amino acid
  Variant (818)..(818): Xaa in position 818 is any amino acid
  Variant (821)..(823): Xaa in position 821 to 823 is any amino acid
  Variant (830)..(830): Xaa in position 830 is any amino acid
  Variant (847)..(847): Xaa in position 847 is any amino acid
  Variant (849)..(849): Xaa in position 849 is any amino acid
  Variant (851)..(854): Xaa in position 851 to 854 is any amino acid
  Variant (856)..(902): Xaa in position 856 to 902 is any amino acid
  Variant (903)..(930): Xaa in position 903 to 930 is any or no amino acid
  Variant (939)..(940): Xaa in position 939 to 940 is any amino acid
  Variant (942)..(942): Xaa in position 942 is any amino acid
  Variant (944)..(945): Xaa in position 944 to 945 is any amino acid
  Variant (948)..(948): Xaa in position 948 is any amino acid
  Variant (951)..(952): Xaa in position 951 to 952 is any amino acid
  Variant (955)..(957): Xaa in position 955 to 957 is any amino acid
  Variant (959)..(960): Xaa in position 959 to 960 is any amino acid
  Variant (962)..(964): Xaa in position 962 to 964 is any amino acid
MEXXXXXXXKKXXQXXXFXXXAXXXXXXXXXXXXXXXXXXXXXXXXXXXXXXXXXXXXXXXXXXEXXLXXDDFXXLISXSXXXYSKFXXHXFNLNQXPXXXFGCIFFAXDEXNKGYLXXXDWFXXNNXLEXXNYHXIXLYEFFRKFDXXXXXAXXXXXXXXXXXXXXXXXXXXXXXXXXXXXXXXXXKXINYXNXFLSFDXLXLXXXQFXXTXXXLXXXXXXDXFXXXNXLXLXWXXFXXXXXYXXXXXXXXXXXXXXXLNSLXXIXQXDLKXEKXXXGFXXLXXXXXXXXXXXXXKNQLXYLXXLFYSHXXXXDXFXSLXXSXXXXXKXDNNXIXXNVXXDXFYLXXNFDLLNQXXXXYXXXXXXXXXDXREQXXXXXXXXXXXNXXYNKXXNIXEFSPXQIXLLFSIVXNSKXXXXXXXXXXXXXXXXXXXXHXDXXIXXFIHXXXXXGXXXXXXXXXXXXXFNXXXXXXXXXXXXXXXXQXSXXXXXXXXXXXXXXXXXXXXXXXXXXXXXXXXXXXXXXXXXLTXXDXXKIXNPNYLNDXVHXXELXXXXXESXXXNXYFYPIFDSXXNFXLGSXAGCIGAXXVYPIDXXKTRMQAQRXXXXYKNSIDCXXKIXXXXGXXGXYSGLGPQLIGVAPEKAIKLTVNDXMRXXXXXXXXXXXXXXEIXSGAXAGACQVXFTNPLEIVKIRLQXXXXYVXXXXXXXXXXAXXXXXXLGLXGLYXGXXACLXRDXPFSAIYFPTYAHXKXXXFXFDPXDXXKRXXLXTWXLLXXGXXAGMPAAXLTTPFDVIKTRLQIDPXKGEXXYXGXXXAXRTILXEEXXXSFFKGGXARVLRSSPQFGFTLAAXEXFXXXXPXXXXXXXXXXXXXXXXXXXXXXXXXXXXXXXXXXXXXXXXXXXXXXXXXXXXXXXXXXXXXXXXXXXXXXXXXXXNYYYKSCQXXKXFXXLDXNFXXFDXXXYXXFXXXL

SEQ ID NO: 73400 - protein, 60 aa, Artificial sequence
  protein pattern
  Variant (6)..(6): Xaa in position 6 is any amino acid
  Variant (7)..(7): Xaa in position 7 is Ile or Val
  Variant (13)..(13): Xaa in position 13 is Phe, Leu or Met
  Variant (14)..(14): Xaa in position 14 is Ile or Val
  Variant (23)..(23): Xaa in position 23 is Asp, Asn or Ser
  Variant (24)..(24): Xaa in position 24 is any amino acid
  Variant (25)..(25): Xaa in position 25 is Ala, Ser or Val
  Variant (26)..(26): Xaa in position 26 is any amino acid
  Variant (34)..(34): Xaa in position 34 is Phe, Leu or Val
  Variant (35)..(35): Xaa in position 35 is Leu or Val
  Variant (38)..(38): Xaa in position 38 is Phe, Ile or Leu
  Variant (39)..(39): Xaa in position 39 is Gln or Ser
  Variant (40)..(40): Xaa in position 40 is any amino acid
  Variant (41)..(41): Xaa in position 41 is Glu or Lys
  Variant (43)..(43): Xaa in position 43 is Ile or Val
  Variant (44)..(44): Xaa in position 44 is Lys or Arg
  Variant (46)..(46): Xaa in position 46 is Leu or Val
GCIGAXXVYPIDXXKTRMQAQRXXXXYKNSIDCXXKIXXXXGXXGXYSGLGPQLIGVAPE

SEQ ID NO: 73401 - protein, 60 aa, Artificial sequence
  protein pattern
  Variant (2)..(2): Xaa in position 2 is any amino acid
  Variant (4)..(4): Xaa in position 4 is Phe or Tyr
  Variant (21)..(21): Xaa in position 21 is Lys or Arg
  Variant (25)..(25): Xaa in position 25 is Ser or Thr
  Variant (26)..(26): Xaa in position 26 is any amino acid
  Variant (28)..(28): Xaa in position 28 is any amino acid
  Variant (30)..(30): Xaa in position 30 is any or no amino acid
  Variant (32)..(32): Xaa in position 32 is any amino acid
  Variant (33)..(33): Xaa in position 33 is any or no amino acid
  Variant (35)..(35): Xaa in position 35 is Ala or Ile
  Variant (40)..(40): Xaa in position 40 is Lys or Arg
  Variant (43)..(43): Xaa in position 43 is Gly or Ser
  Variant (44)..(44): Xaa in position 44 is Phe or Ile
  Variant (45)..(45): Xaa in position 45 is Lys or Arg
  Variant (52)..(52): Xaa in position 52 is Ala, Gly or Pro
PXAXLTTPFDVIKTRLQIDPXKGEXXYXGXIXXAXRTILXEEXXXSFFKGGXARVLRSSP

SEQ ID NO: 73402 - protein, 59 aa, Artificial sequence
  protein pattern
  Variant (6)..(6): Xaa in position 6 is Ile or Val
  Variant (8)..(8): Xaa in position 8 is any or no amino acid
  Variant (10)..(10): Xaa in position 10 is any amino acid
  Variant (11)..(11): Xaa in position 11 is any or no amino acid
  Variant (19)..(19): Xaa in position 19 is Ile or Met
  Variant (22)..(22): Xaa in position 22 is Asn or Gln
  Variant (28)..(28): Xaa in position 28 is Asn or Thr
  Variant (29)..(29): Xaa in position 29 is Ile, Leu or Val
  Variant (30)..(30): Xaa in position 30 is Asn or Ser
  Variant (34)..(34): Xaa in position 34 is any amino acid
  Variant (35)..(35): Xaa in position 35 is Phe or Leu
  Variant (38)..(38): Xaa in position 38 is Ile, Leu or Val
  Variant (41)..(41): Xaa in position 41 is Phe, His or Tyr
  Variant (42)..(42): Xaa in position 42 is Asp, Glu or Asn
  Variant (46)..(46): Xaa in position 46 is Phe or Leu
  Variant (48)..(48): Xaa in position 48 is Ile or Val
  Variant (58)..(58): Xaa in position 58 is Ala or Val
  Variant (59)..(59): Xaa in position 59 is Ala or Glu
FNLNQXPXNXXFGCIFFAXDEXNKGYLXXXDWFXXNNXLEXXNYHXIXLYEFFRKFDXX

SEQ ID NO: 73403 - protein, 62 aa, Artificial sequence
  protein pattern
  Variant (3)..(3): Xaa in position 3 is any amino acid
  Variant (7)..(7): Xaa in position 7 is any amino acid
  Variant (9)..(9): Xaa in position 9 is any or no amino acid
  Variant (11)..(11): Xaa in position 11 is any or no amino acid
  Variant (13)..(13): Xaa in position 13 is any or no amino acid
  Variant (16)..(16): Xaa in position 16 is Leu or Met
  Variant (19)..(19): Xaa in position 19 is Ile or Val
  Variant (32)..(32): Xaa in position 32 is Ile or Leu
  Variant (34)..(34): Xaa in position 34 is any amino acid
  Variant (35)..(35): Xaa in position 35 is Asp or Asn
  Variant (36)..(36): Xaa in position 36 is Leu or Val
  Variant (38)..(38): Xaa in position 38 is Asp or Asn
  Variant (42)..(42): Xaa in position 42 is any amino acid
  Variant (44)..(44): Xaa in position 44 is any amino acid
  Variant (45)..(45): Xaa in position 45 is Asp, Asn or Thr
  Variant (48)..(48): Xaa in position 48 is Asn or Ser
  Variant (49)..(49): Xaa in position 49 is Lys or Arg
  Variant (51)..(51): Xaa in position 51 is any amino acid
  Variant (54)..(54): Xaa in position 54 is Glu or Gln
  Variant (57)..(57): Xaa in position 57 is any amino acid
  Variant (58)..(58): Xaa in position 58 is Ala or Ser
  Variant (60)..(60): Xaa in position 60 is Ala or Gly
  Variant (61)..(61): Xaa in position 61 is Ile or Leu
GLXGLYXGXAXAXCLXRDXPFSAIYFPTYAHXKXXXFXFDPXDXXKRXXLXTWXLLXXGXXA

SEQ ID NO: 73404 - protein, 60 aa, Artificial sequence
  protein pattern
  Variant (10)..(10): Xaa in position 10 is Phe, His or Tyr
  Variant (13)..(13): Xaa in position 13 is Ala, Asn or Gln
  Variant (14)..(14): Xaa in position 14 is any amino acid
  Variant (15)..(15): Xaa in position 15 is Phe or Leu
  Variant (16)..(16): Xaa in position 16 is any amino acid
  Variant (17)..(17): Xaa in position 17 is Asp, Gly or Asn
  Variant (18)..(18): Xaa in position 18 is Lys or Arg
  Variant (19)..(19): Xaa in position 19 is Asp, Asn or Ser
  Variant (20)..(21): Xaa in position 20 to 21 is any amino acid
  Variant (22)..(22): Xaa in position 22 is Ile or Leu
  Variant (23)..(26): Xaa in position 23 to 26 is any amino acid
  Variant (29)..(29): Xaa in position 29 is Ile or Leu
  Variant (33)..(33): Xaa in position 33 is Ser or Thr
  Variant (40)..(40): Xaa in position 40 is Ile or Val
  Variant (54)..(54): Xaa in position 54 is Met or Val
  Variant (55)..(55): Xaa in position 55 is any amino acid
  Variant (56)..(56): Xaa in position 56 is Gly or Ser
  Variant (57)..(57): Xaa in position 57 is Asp or Glu
  Variant (60)..(60): Xaa in position 60 is Ala or Gly
KAIKLTVNDXMRXXXXXXXXXXXXXXEIXSGAXAGACQVXFTNPLEIVKIRLQXXXXYVX

SEQ ID NO: 73405 - protein, 54 aa, Artificial sequence
  protein pattern
  Variant (3)..(3): Xaa in position 3 is Ile, Leu, Met or Val
  Variant (4)..(4): Xaa in position 4 is Glu or Gln
  Variant (6)..(6): Xaa in position 6 is Phe or Ile
  Variant (7)..(7): Xaa in position 7 is Leu or Met
  Variant (10)..(10): Xaa in position 10 is Leu or Val
  Variant (18)..(18): Xaa in position 18 is Ile, Leu or Val
  Variant (21)..(21): Xaa in position 21 is any amino acid
  Variant (22)..(22): Xaa in position 22 is Leu or Met
  Variant (25)..(25): Xaa in position 25 is any amino acid
  Variant (26)..(26): Xaa in position 26 is His, Lys or Arg
  Variant (27)..(27): Xaa in position 27 is any amino acid
  Variant (28)..(28): Xaa in position 28 is Glu, Gln or Arg
  Variant (29)..(29): Xaa in position 29 is Glu, Asn or Ser
  Variant (32)..(34): Xaa in position 32 to 34 is any amino acid
  Variant (36)..(36): Xaa in position 36 is any amino acid
  Variant (45)..(45): Xaa in position 45 is Ile or Leu
  Variant (46)..(46): Xaa in position 46 is His or Tyr
  Variant (49)..(49): Xaa in position 49 is Ser or Thr
  Variant (53)..(53): Xaa in position 53 is Ile or Val
LTXXDXXKIXNPNYLNDXVHXXELXXXXXESXXXNXYFYPIFDSXXNFXLGSXA

SEQ ID NO: 73406 - protein, 62 aa, Artificial sequence
  protein pattern
  Variant (5)..(5): Xaa in position 5 is Ser, Thr or Val
  Variant (8)..(9): Xaa in position 8 to 9 is any or no amino acid
  Variant (11)..(12): Xaa in position 11 to 12 is any or no amino acid
  Variant (17)..(17): Xaa in position 17 is Lys or Arg
  Variant (18)..(18): Xaa in position 18 is Ile or Val
  Variant (19)..(19): Xaa in position 19 is Pro or Ser
  Variant (20)..(20): Xaa in position 20 is Ala or Ser
  Variant (22)..(22): Xaa in position 22 is Ile or Val
  Variant (24)..(24): Xaa in position 24 is Glu, Asn or Ser
  Variant (27)..(27): Xaa in position 27 is Asp or Asn
  Variant (28)..(28): Xaa in position 28 is Leu or Met
  Variant (30)..(30): Xaa in position 30 is Asn or Thr
  Variant (31)..(33): Xaa in position 31 to 33 is any amino acid
  Variant (34)..(34): Xaa in position 34 is Ala, Ile or Leu
  Variant (36)..(36): Xaa in position 36 is Ala, Cys or Ser
  Variant (40)..(40): Xaa in position 40 is any amino acid
  Variant (42)..(42): Xaa in position 42 is any amino acid
  Variant (43)..(43): Xaa in position 43 is Phe or Tyr
  Variant (46)..(46): Xaa in position 46 is any amino acid
  Variant (47)..(47): Xaa in position 47 is Lys or Arg
  Variant (49)..(49): Xaa in position 49 is Ile or Leu
  Variant (53)..(53): Xaa in position 53 is Phe or Ile
  Variant (54)..(54): Xaa in position 54 is Glu or Gln
  Variant (62)..(62): Xaa in position 62 is Ile or Val
KNQLXYLXXLXXFYSHXXXXDXFXSLXXSXXXXXKXDNNXIXXNVXXDXFYLXXNFDLLNQX

SEQ ID NO: 73407 - protein, 56 aa, Artificial sequence
  protein pattern
  Variant (2)..(2): Xaa in position 2 is Ala or Val
  Variant (3)..(3): Xaa in position 3 is Glu, Gln or Thr
  Variant (4)..(6): Xaa in position 4 to 6 is any amino acid
  Variant (7)..(7): Xaa in position 7 is Phe, Leu or Met
  Variant (8)..(8): Xaa in position 8 is Asp, Asn or Ser
  Variant (9)..(9): Xaa in position 9 is Asp or Glu
  Variant (10)..(10): Xaa in position 10 is Asn, Gln or Arg
  Variant (12)..(12): Xaa in position 12 is Ile or Val
  Variant (16)..(16): Xaa in position 16 is any or no amino acid
  Variant (18)..(18): Xaa in position 18 is any amino acid
  Variant (19)..(19): Xaa in position 19 is any or no amino acid
  Variant (21)..(26): Xaa in position 21 to 26 is any amino acid
  Variant (27)..(27): Xaa in position 27 is any or no amino acid
  Variant (29)..(29): Xaa in position 29 is any amino acid
  Variant (30)..(30): Xaa in position 30 is Glu or Gln
  Variant (34)..(34): Xaa in position 34 is Ile or Val
  Variant (35)..(35): Xaa in position 35 is Asn or Thr
  Variant (38)..(38): Xaa in position 38 is any amino acid
  Variant (43)..(43): Xaa in position 43 is Ala or Ser
  Variant (46)..(46): Xaa in position 46 is Asn or Ser
  Variant (53)..(53): Xaa in position 53 is Ala, Ser or Thr
YXXXXXXXXXDXREQXIXXKXXXXXXXNXXYNKXXNIXEFSPXQIXLLFSIVXNSK

SEQ ID NO: 73408 - protein, 40 aa, Artificial sequence
  protein pattern
  Variant (2)..(2): Xaa in position 2 is any amino acid
  Variant (3)..(9): Xaa in position 3 to 9 is any or no amino acid
  Variant (15)..(15): Xaa in position 15 is Ile or Val
  Variant (16)..(16): Xaa in position 16 is Ala or Ser
  Variant (18)..(18): Xaa in position 18 is Ala, Thr or Val
  Variant (20)..(20): Xaa in position 20 is Ile or Met
  Variant (21)..(21): Xaa in position 21 is Asp or Glu
  Variant (24)..(24): Xaa in position 24 is any amino acid
  Variant (27)..(27): Xaa in position 27 is Ala or Ser
  Variant (28)..(28): Xaa in position 28 is His, Lys or Arg
  Variant (31)..(31): Xaa in position 31 is any amino acid
  Variant (32)..(32): Xaa in position 32 is Gly, Asn or Ser
  Variant (33)..(33): Xaa in position 33 is Thr or Val
  Variant (35)..(36): Xaa in position 35 to 36 is any amino acid
  Variant (38)..(38): Xaa in position 38 is any amino acid
  Variant (39)..(39): Xaa in position 39 is Asp or Glu
  Variant (40)..(40): Xaa in position 40 is Glu or His
YXXXXXXXXYKSCQXXKXFXXLDXNFXXFDXXXYXXFXXX

SEQ ID NO: 73409 - protein, 35 aa, Artificial sequence
  protein pattern
  Variant (3)..(3): Xaa in position 3 is Ala or Gly
  Variant (5)..(5): Xaa in position 5 is Lys or Arg
  Variant (11)..(11): Xaa in position 11 is Asp or Glu
  Variant (13)..(13): Xaa in position 13 is any amino acid
  Variant (15)..(15): Xaa in position 15 is Asp or Asn
  Variant (16)..(16): Xaa in position 16 is Leu or Val
  Variant (17)..(17): Xaa in position 17 is Asp, Glu or Asn
  Variant (20)..(20): Xaa in position 20 is any amino acid
  Variant (21)..(21): Xaa in position 21 is Ala, Asp, Glu or Ser
  Variant (23)..(24): Xaa in position 23 to 24 is any amino acid
  Variant (25)..(25): Xaa in position 25 is any or no amino acid
  Variant (27)..(28): Xaa in position 27 to 28 is any amino acid
  Variant (29)..(29): Xaa in position 29 is Cys or Ser
  Variant (30)..(30): Xaa in position 30 is Ile or Val
  Variant (31)..(31): Xaa in position 31 is any amino acid
  Variant (32)..(32): Xaa in position 32 is Asp or Asn
  Variant (33)..(33): Xaa in position 33 is Asp, Glu or Asn
  Variant (34)..(34): Xaa in position 34 is any amino acid
  Variant (35)..(35): Xaa in position 35 is Phe, Ile or Val
NYXNXFLSFDXLXLXXXQFXXTXXXLXXXXXXXXX

SEQ ID NO: 73410 - protein, 36 aa, Artificial sequence
  protein pattern
  Variant (4)..(4): Xaa in position 4 is Ile or Val
  Variant (5)..(5): Xaa in position 5 is Ser or Thr
  Variant (7)..(7): Xaa in position 7 is Leu or Val
  Variant (9)..(9): Xaa in position 9 is Asn or Ser
  Variant (13)..(13): Xaa in position 13 is any amino acid
  Variant (16)..(16): Xaa in position 16 is any amino acid
  Variant (17)..(19): Xaa in position 17 to 19 is any or no amino acid
  Variant (21)..(22): Xaa in position 21 to 22 is any amino acid
  Variant (24)..(24): Xaa in position 24 is Ala, Cys or Ser
  Variant (25)..(25): Xaa in position 25 is any amino acid
  Variant (26)..(26): Xaa in position 26 is Phe, Leu or Met
  Variant (27)..(27): Xaa in position 27 is Asp or Asn
  Variant (28)..(28): Xaa in position 28 is any amino acid
  Variant (29)..(29): Xaa in position 29 is Gln, Arg or Ser
  Variant (30)..(33): Xaa in position 30 to 33 is any amino acid
  Variant (34)..(34): Xaa in position 34 is Ala, Ser or Thr
  Variant (35)..(35): Xaa in position 35 is Ile or Leu
  Variant (36)..(36): Xaa in position 36 is Asn or Ser
NSLXXIXQXDLKXEKXXXXFXXLXXXXXXXXXXXXX

SEQ ID NO: 73411 - protein, 18 aa, Artificial sequence
  protein pattern
  Variant (9)..(9): Xaa in position 9 is Phe or Tyr
  Variant (11)..(11): Xaa in position 11 is Ile, Leu or Met
  Variant (13)..(14): Xaa in position 13 to 14 is any amino acid
  Variant (15)..(15): Xaa in position 15 is any or no amino acid
  Variant (17)..(17): Xaa in position 17 is any or no amino acid
QFGFTLAAXEXFXXXFXP

SEQ ID NO: 73412 - protein, 17 aa, Artificial sequence
  protein pattern
  Variant (2)..(2): Xaa in position 2 is Asp or Lys
  Variant (4)..(4): Xaa in position 4 is any or no amino acid
  Variant (6)..(6): Xaa in position 6 is any amino acid
  Variant (7)..(7): Xaa in position 7 is any or no amino acid
  Variant (9)..(10): Xaa in position 9 to 10 is any amino acid
  Variant (12)..(12): Xaa in position 12 is Asp or Arg
  Variant (13)..(13): Xaa in position 13 is Phe or Trp
  Variant (14)..(14): Xaa in position 14 is Phe or Leu
  Variant (15)..(16): Xaa in position 15 to 16 is any amino acid
NXLXLXXWXXFXXXXXY

SEQ ID NO: 73413 - protein, 19 aa, Artificial sequence
  protein pattern
  Variant (2)..(2): Xaa in position 2 is any amino acid
  Variant (3)..(3): Xaa in position 3 is any or no amino acid
  Variant (5)..(5): Xaa in position 5 is Glu or Ser
  Variant (6)..(6): Xaa in position 6 is Asp, Glu or Thr
  Variant (8)..(8): Xaa in position 8 is any amino acid
  Variant (9)..(9): Xaa in position 9 is any or no amino acid
  Variant (11)..(11): Xaa in position 11 is any or no amino acid
  Variant (14)..(14): Xaa in position 14 is Asn or Ser
  Variant (15)..(15): Xaa in position 15 is Glu or Gln
  Variant (16)..(18): Xaa in position 16 to 18 is any amino acid
HXXDXXIXXFXIHXXXXXG

SEQ ID NO: 73414 - protein, 21 aa, Artificial sequence
  protein pattern
  Variant (2)..(2): Xaa in position 2 is any amino acid
  Variant (3)..(3): Xaa in position 3 is Phe or Tyr
  Variant (7)..(7): Xaa in position 7 is Ile or Val
  Variant (8)..(8): Xaa in position 8 is Asp, Glu or Arg
  Variant (12)..(12): Xaa in position 12 is Asn or Ser
  Variant (14)..(14): Xaa in position 14 is any amino acid
  Variant (15)..(17): Xaa in position 15 to 17 is any or no amino acid
  Variant (21)..(21): Xaa in position 21 is Ser or Thr
LXXDDFXXLISXSXXXXSKFX

SEQ ID NO: 73415 - DNA, 2586 bp, Saccharomyces cerevisiae
  CDS (1)..(2586)
atggaagggcaaaaatcgaatgcatcatgggagagctcgatcatcgagggccaattgtctaaaaatctagcaaggtacaccttgttattagacaaattatcgacactatctcaaatagacaagctgtctgaagtgatagccaatgattacgcaaaacaatctaaacaattaaatgcatttgtgcaacagtcgcaatcatcgctcaacaaagagtcccggaaattagaattgcaaagaactaaccttacgactactttgactcagtttcatgagactgtggccaccatttcttcttcgaacgcaagagcaaaagctatacatgacgatattgaaactgtagatcaggaacgcgctttggtcaacaaaacgttacaatttgtaaaagacgtcaggacgctaaagaataatatttcactggcgcattctgctttagaaacaaaggattacttagttgctgcgacagcaatcaatgaaattagaagccttccggataaaaaacttattgtatccgagtttgccaagaaagttgtgccctcgagtgaaattcccgaagaaccagctatactaataaagaattggtgtaaggaactgacaagtttatttcaggagcaattcatggaagcaacaagaacacaggatattaaagagctaaccttaatgttcaaaatgttccctatgattgggcaggacgtacttggtttagacctgtattccaaatatgtctgtgatattattgcggacgaaagcaggaaaattatgtcgaattctatggaaaacagcaccaagtttcaaggatttttttcacaagtactgttacatctttttaaaattgtatcgaccattataaatgatcattcaaaagtcatcgccacgtgttatggaaaaaagcacatggtgcatgtcatggaaaaagtagaaaaagaagctgatcttcaagctagtttgattctagatatttttatggagacgaggaaaatagaaaggactatacatgatataaatgaatgggaacattcacaaaagaatgaagatgtgaatatagacagtaatcagtcggatatcgaaacagacggagaaacggaaaagagctcaattatatccattcatgacttggcattattgataatggaattttctcaaatacttcaaaattggtccatgtattctagattttattcagttaaatggaatgaatttagcgatttgcatccgcatgtattgcaaccacctccaccaatagcagatggtaaatttgccttaaagttaaagcaagataaggtctttgatgagtttcaggtgtttgtgttgaaccatctgcagagatcatttagaaatagtatttcactagaagaattaccgtcactgaacgatcttataactgctgttcccctcaatgaccacgataacatttcataccctgtaacatctgttttagatgacttaattttattagttcggaaaaatctgatatcagtggttaatactggccagtttaagctcttagcaagttttttgaacgagttggtaaaattttttcagaaccgatttctggtaaaatttatgcaaaacaaatttaagttactacaatcgaaactagcctccaatgtatctttgaaaagatacattccaaaaggtgaggagcaatctgcaacatcaagatcggtttctccacctgcaaataagttttctccgctaagcaggttcacttttagaggggcagcagctagcgctttgacaaatattcaatcaaatttacaagccgtagttgcagaggacgaggattccattcttgcgttgcaccattatttgatatatctgaacacgttgtacttgagtaaagtatacgttcacaggctgttatccatagaaatattagaagacgattcgcaaaggattttgagagacaatttcccttttgacaatgatgcagcgcagttacagaatttaattataaactcagaaaaattagtcctggaacaaacagataagctaagcaaatgggctgtcaaatacttgttccaaaatatcctacaaaatagggttcggaacttattgggaactgtttttgttaattcagcctcatcaaattcctcaacgtccaatcaaaaaaatgtgtctcgcgattattctgcaggttcgaaccaaaagaattacatcacaagcatagaagatttcgaagatttgtcgcaaattaacagtttcaatagcaaatggaaccaattgattatcccttacaaaaatattcttcacaacgaagcatatgcagagttgctatctgtcatagtcgactacatcgtaacaacattggagcaaagaatatggactctagaattcaatgaacttggtgttacgaaattagatagagaactgagccttttcatcggcaatatgtgtggcttgaactataatctcagagagaagttcttgaaattgacacaaatcgtgttgcttctcggtttagatgatgacaattttgatttgactacaggtgatatcaaggatgacttcaatggtactttcgattgggtgataaactctcaggaaagaattaaagctagaaatatgaagattgatagaacacagtaa

SEQ ID NO: 73416 - protein, 861 aa, Saccharomyces cerevisiae
MEGQKSNASWESSIIEGQLSKNLARYTLLLDKLSTLSQIDKLSEVIANDYAKQSKQLNAFVQQSQSSLNKESRKLELQRTNLTTTLTQFHETVATISSSNARAKAIHDDIETVDQERALVNKTLQFVKDVRTLKNNISLAHSALETKDYLVAATAINEIRSLPDKKLIVSEFAKKVVPSSEIPEEPAILIKNWCKELTSLFQEQFMEATRTQDIKELTLMFKMFPMIGQDVLGLDLYSKYVCDIIADESRKIMSNSMENSTKFQGFFSQVLLHLFKIVSTIINDHSKVIATCYGKKHMVHVMEKVEKEADLQASLILDIFMETRKIERTIHDINEWEHSQKNEDVNIDSNQSDIETDGETEKSSIISIHDLALLIMEFSQILQNWSMYSRFYSVKWNEFSDLHPHVLQPPPPIADGKFALKLKQDKVFDEFQVFVLNHLQRSFRNSISLEELPSLNDLITAVPLNDHDNISYPVTSVLDDLILLVRKNLISVVNTGQFKLLASFLNELVKFFQNRFLVKFMQNKFKLLQSKLASNVSLKRYIPKGEEQSATSRSVSPPANKFSPLSRFTFRGAAASALTNIQSNLQAVVAEDEDSILALHHYLIYLNTLYLSKVYVHRLLSIEILEDDSQRILRDNFPFDNDAAQLQNLIINSEKLVLEQTDKLSKWAVKYLFQNILQNRVRNLLGTVFVNSASSNSSTSNQKNVSRDYSAGSNQKNYITSIEDFEDLSQINSFNSKWNQLIIPYKNILHNEAYAELLSVIVDYIVTTLEQRIWTLEFNELGVTKLDRELSLFIGNMCGLNYNLREKFLKLTQIVLLLGLDDDNFDLTTGDIKDDFNGTFDWVINSQERIKARNMKIDRTQ

SEQ ID NO: 73417 - DNA, 2544 bp, Aspergillus fumigatus
  CDS (1)..(2544)
atgtccaggacagaacactccatcaccaacgggcgtgcggtctcgtctgcacaaaatggagaacgcccgaacgcccacctcccaattgacgtgttcaacgccagttccgttgcggagatcaaggccgccctgtcacacctccatgatcaagaggtcgccgtcaccgctcggttggacgcccttgtcgcatcacagaaagatttctcccgggagctagggcggctagatcttcttcgcgcccatttgggttcccagaccagcaccacccacgcaatcagccatggcatgttgtccgacgctgcggcgaccgcagatcgcatctcgagcgccgtccgtcagctcgacctggagcagtcaagagtgaaagcgacgctggaagtggtagagcaggtttcggaactgaaggcttgcgttctgggggttgcaggctccatgggggccccgcaggactgggaaacggcggccagttatttgaaccgggcgtccaaggtacctccggaggtggttcacggtacttttgcagcagagatggtgccgaccgctgaggttcctgacccgccaaatgtcactctggacaatgcggctgaatcgctttgcggcttattcctgcgcgagttcgacaaggccgtcaaagagaacgatggcgccaagattacgcggttcttcaagctctttcctcttattggccgctccgaggttggtctggatgtgtatgggcgctatgtatgccagggagtggcatcgcgggcgcgagcgaacctcaatgccggcacgggaggtgctcaaagcaaagatggcttcttctacgcaaatgcgctgacgaaactgtttgagcatatcgcccagctcatcgacggacatggagggcttgtggagcgccattacggcccgcggaagatgaccagggtcattgaacgtctacagctcgaggcggatctccagggtgggattattctggacacctggagcgacgagcggcacatcgatcgcaagcttacagacatcaaatcgtatgcctttactttcttggtacagagttttcttcccgctcaacgcagtgcaacgcctcggtcgaattccccggcgactcgcgatgggctccccgctgaagacgagggtgtagacatgaaggagatcgacgggctactaaacgaaatggcagtcatgctgagccgctggtctctctactgtcgattcatcgctgaaacttgcaatgtacgttacctgactgcctcaacaagcctttgcatggacgtattcggaaagctaacactgtgcaaggccaccgaggacgagagtcaaaagtttacgccacccaagtttctacaggaagcgagtctttccaagaaaatcactgaccgtctgatcaatccattcaatactatgacgacttttttctttcgtcgctcggttgaaaaggcgtttcaattggatgaacagccttctggtctgacactacaccctcaaaagccattgaaggcagatcctcctcatatcacatctgcagtggacgacattatgtatattgtcaacaaggtcttgcaacagtcactggccacgtcacaaatctcggtagtgactaatgtcgtccccacattgggacgagttcttggatcggacttcatcggaatgacccaaagaaagatgcgtgatgaatgctatcccaaagcgcccgtccagggggctcagccgcctgaacagaccgtaatctcttttctggtcttgatcaataacctggatgttgccgtcgactacatacgccgcattgtgcagaaccacaccgagacgaaaaagaccatcactggcccggacggtcaggttgaggaaactgacccgctgaggtccctgttccccgtgcctgcagaagcccaacttgcggctcagacgctgcagaccctcgcctcgtccttcgagtccaaggtgaacgacctcctgtccgacggtattcaggtcgtattcaacaatgtcgtcaagcaccgcctgcgacctatccttgcagatgctttcagagacgtcgaataccagccacgggatgacagcgacccaacgagcacagtctaccacgagtacggcgacggcgacgaggacgtcgacgacggcgccagccgagcggagctagtccgtccccgtttcgccgccagctggaccgcgcttctcctccccatctcccgcatcctcacagcctcgagctttgatcgcctcctgaacgtcacagtcgcgtatctggcccgcctgctcgagaagcgactatggtcataccacggacggatcaacgcactcggcgccacccgactcgagcgcgacgtctcgggcgtggtgaacgcagcggtggacgtcggcggcgcccagggtgcctcaggacgataccgacaccgggaggcgttcgcccgctgcctgcagatggtgctggtgatgggcatggacgacgacgaatgggaggatgtcacccgcggcggcgaaacggcagacgtgctcgataagatcagccgggaggagcgcgcgcgcatccgtgcaatggtgcggcgacttcgccgcgaactgtaa

SEQ ID NO: 73418 - protein, 847 aa, Aspergillus fumigatus
MSRTEHSITNGRAVSSAQNGERPNAHLPIDVFNASSVAEIKAALSHLHDQEVAVTARLDALVASQKDFSRELGRLDLLRAHLGSQTSTTHAISHGMLSDAAATADRISSAVRQLDLEQSRVKATLEVVEQVSELKACVLGVAGSMGAPQDWETAASYLNRASKVPPEVVHGTFAAEMVPTAEVPDPPNVTLDNAAESLCGLFLREFDKAVKENDGAKITRFFKLFPLIGRSEVGLDVYGRYVCQGVASRARANLNAGTGGAQSKDGFFYANALTKLFEHIAQLIDGHGGLVERHYGPRKMTRVIERLQLEADLQGGIILDTWSDERHIDRKLTDIKSYAFTFLVQSFLPAQRSATPRSNSPATRDGLPAEDEGVDMKEIDGLLNEMAVMLSRWSLYCRFIAETCNVRYLTASTSLCMDVFGKLTLCKATEDESQKFTPPKFLQEASLSKKITDRLINPFNTMTTFFFRRSVEKAFQLDEQPSGLTLHPQKPLKADPPHITSAVDDIMYIVNKVLQQSLATSQISVVTNVVPTLGRVLGSDFIGMTQRKMRDECYPKAPVQGAQPPEQTVISFLVLINNLDVAVDYIRRIVQNHTETKKTITGPDGQVEETDPLRSLFPVPAEAQLAAQTLQTLASSFESKVNDLLSDGIQVVFNNVVKHRLRPILADAFRDVEYQPRDDSDPTSTVYHEYGDGDEDVDDGASRAELVRPRFAASWTALLLPISRILTASSFDRLLNVTVAYLARLLEKRLWSYHGRINALGATRLERDVSGVVNAAVDVGGAQGASGRYRHREAFARCLQMVLVMGMDDDEWEDVTRGGETADVLDKISREERARIRAMVRRLRREL

SEQ ID NO: 73419 - DNA, 2490 bp, Eremothecium gossypii
  CDS (1)..(2490)
atggccgccgatggggatccaattgcgctccacacgatcagcgacgatgtgctggctgcgaaactggcacggtataagaaacttatgaacaactttgcgacgctttctcaggcgaccaaactcgaaaaggtgatcaatagagatcacagagagaccgagcaggaattgcaagagatcatcgaagagtcgcagacccgtgataatcaggagattaggaaactggagctcaggaggacaaacctgacctcgtcgttgggtaagttccatgccacactggaacagctttccggctcgagcgagtccgcgaggcagatctcggcgcggattaggatgatcgaacgcgaaaggacgttagttcacaagaccctgcagtttattgaacaatgcaggcaactgaagtacagcatttcggtggtgagtagcgcgttggagaagaatgaccaccgtttagcagccaataccatcgagaagatccggacactgccgcccgaagttgtcgaatctgagtttgcgaatagggtggtcccttgtagtgagatcccagagcaaccagcacagctgctgaaggactggacttctaggttatcggaggtatttacggaacagttccagcacgcggcaaaagcgcaagatgtggaacagttgacatcctactttgagctattccctaagataggatatgccgagctggggttggaagtctactccaagtatgtgtgcgatatcattgcaggtcagagtcgtaaaatcatgacaggctctactgagagacggcatatgttttactccaaggcgctgctccatctcttcaaaaccgtgtccaccattataaatagccactcgcaggttatctcagggtgctatggcgcgaaatatatggtgcatatcatggacaaagttcaaaaggaagcagacttacaagcagggataatatgggacacattcatggatgtccggcgcattgaatatctgcttgctgaaatcagggagtggcacgaagcacaggcccaagccaacaaaaatcatctccatggcgcaaagccaaatagcaggccacccccaagctccattaacgaattaacaatgttgatttctgaatattcagccatcttccagcattggtccatgtactgcaggtttttcgctctgaagtgggatgagttttcgcagaacacggccacagagttagagctaccgagccttatttcggaaggaaagttcagcgcaaaggtgactgactctatgtctgggtttgaacaactggtgcgccaccaactctataggtcattcgcaaatgctgtcgacctagaagaactaccatctttgaacgactatttagggccgaccccatacgaccacgaagatttatcgagctatcctataagctctatcctggaagacctagttctgctcattcgagtcaatctaattgcaactgtgaacactggtcagaaggcactgctctataagttctctgaagctttaatgaggtttatccagaccgaattcctgattaaagtgctacaatcaagatttaagaatattcaacctcgtcttaacccttcccttgtgttgaaaaaatacctgccgtcttcagatcctacatcagtcggtatgaggtctctctcgccaaagcctgtaacacaggatactggtaaattgtcacagttcggcttcaattttaagagcgctgcgacaagcacgttaacaaacctgcagtctaatatacaatctgtctacaccgacgaggaaagcgtgttgaagcttcaccatttcctgatctgtgtcaacactttatccataggtgaggtatttttcaaacgtcttctaatcactgagattttagaagaccagccacagctgttgcacagcaatttcccctttggtcgcgacgcaacggatgtggaatcggtattgcgtactttattcggcaatattcagactcagggcggcaaactgttgaaatggtccctactacaactattcgagaatatgctcaaggggaagcttaaaaggctggttgcacctatgttcgtaagtggaacagaccaggaatacatatgcacggcacatgattttgaaaacctttccactctgaatctctttctgacacagtggaaagaactgatacttcccttttcgaacgttctctacaaaacggcatacatcgagttaatttctcagatgatagactacctctgcgaagccttggaagagaagatatggggcattcagtgtaacgaactcggagggttgaagctggatcgcgaactaagccttatgatcacatccctctgcggccagcactactttctccgtgagaagttcacgagactatcccaattagtcctcgtcctgggcctagatgacgatgactttgacccagccaccggagatataaaggaagaaaccctatcttctattaactggattctcagtgcacctgagagagtgagggctcgcaatatgcgcgtagataagaggagctga

SEQ ID NO: 73420 - protein, 829 aa, Eremothecium gossypii
MAADGDPIALHTISDDVLAAKLARYKKLMNNFATLSQATKLEKVINRDHRETEQELQEIIEESQTRDNQEIRKLELRRTNLTSSLGKFHATLEQLSGSSESARQISARIRMIERERTLVHKTLQFIEQCRQLKYSISVVSSALEKNDHRLAANTIEKIRTLPPEVVESEFANRVVPCSEIPEQPAQLLKDWTSRLSEVFTEQFQHAAKAQDVEQLTSYFELFPKIGYAELGLEVYSKYVCDIIAGQSRKIMTGSTERRHMFYSKALLHLFKTVSTIINSHSQVISGCYGAKYMVHIMDKVQKEADLQAGIIWDTFMDVRRIEYLLAEIREWHEAQAQANKNHLHGAKPNSRPPPSSINELTMLISEYSAIFQHWSMYCRFFALKWDEFSQNTATELELPSLISEGKFSAKVTDSMSGFEQLVRHQLYRSFANAVDLEELPSLNDYLGPTPYDHEDLSSYPISSILEDLVLLIRVNLIATVNTGQKALLYKFSEALMRFIQTEFLIKVLQSRFKNIQPRLNPSLVLKKYLPSSDPTSVGMRSLSPKPVTQDTGKLSQFGFNFKSAATSTLTNLQSNIQSVYTDEESVLKLHHFLICVNTLSIGEVFFKRLLITEILEDQPQLLHSNFPFGRDATDVESVLRTLFGNIQTQGGKLLKWSLLQLFENMLKGKLKRLVAPMFVSGTDQEYICTAHDFENLSTLNLFLTQWKELILPFSNVLYKTAYIELISQMIDYLCEALEEKIWGIQCNELGGLKLDRELSLMITSLCGQHYFLREKFTRLSQLVLVLGLDDDDFDPATGDIKEETLSSINWILSAPERVRARNMRVDKRS

SEQ ID NO: 73421 - DNA, 2409 bp, Gibberella zeae PH-1
  CDS (1)..(2409)
atgtcaagccttccaaacggcttctctcataacgaataccccgtcgtcgaatcctcgattgctgtctctacttcgtcccttgacaatgccaccaccgaggccgagattcgcgatgcgcttgccgccctccatacccgcgagacttctataacctcccgactcgatgctctcgtcgcttcccaagccgacctctcccgtgatctaggacgactggaccttctacgggcgggactgggagcgcaagtcatcgccgcacgatcgattggaaatgatatgctggcgacggcagcagatacggctggtcgactaagcgacagagtcaaagaactggatctggagaaaagtcgagtcgaagagacactaggagtagtggagcaggttgcggagctgaaggcatgtgtcaacggcgtggtcggttccatgggcgcaccccaggactgggaggccgctgctggatatatatcaagagccagtaacgtaccagaggagatcacaaagggatcattcgctgttggcatagtacccagcgtcgaagtacccgacccgccgtgggtgacgcttgaggaagccaaggagagtctatgtggcctcttcttgcgagagttcgaaaaggcggcagaggaaagtgacggaacaaaggttacacggttcttcaagctcttcccgctgataggaagagcagaagttggactagatgtttatggacgatacgtatgccagggagttgctgggacagctcgggcgacgctgaaggatgccatgaatggtcaacgcagggagggcttcttctacgcgaacgctttgacaaaactgtttgagcacattgcacagattgtagagggtcacggtggactcgtggaacgtcactatggcaccggcaagatggtccgggtgattgaacgtttgcagatggaagcggatgtccaaggtggaattattgtcgacacctggagcgacgagaggggaatcgacagaaaactcactgacgtcaggagttacccattctcgttccttgtccagagctttctgccccagccgccccgtggtggtacaccaagagtgaactcaccagctattgggcaaggcaacaaccctcgagagagtgaggatgagggcgtgaatatgagagaggtcgatggcctgctcagcgagattgccgtcatgcttgggcgatggtcgctgtacactcgattcctcgctggcaaatgcaaggacgccgagacaccagatgaagctcctcttgtgataccggatgtactggtcaagtctaatctgtaccgcaaagtgtctacgaaactcacctctccttacaatgtcatgaccacctttttcttccgtcgttcagtggagaaggctttccagctagacgagtaccctactggtctgtcactgagcttaagtagacacattgaaggcaacgctccgtatatcatattggctgtcgacgacgttatgtacatcgtgaacaccgtcatccagaagtccatctcgacctcacaacgagatgttattgcttctgtagtgccaacaattggccgagtgctcggctccgactttgttggcatgattcaacgcaagatgcgggacgaatcgtacccccggcctgttgttcagggggggttcccgcctgaagaccggatcatccagtttattgttctcatcaacagtcttgacatggccaacgagtatttgactcgcatcatcacaggccgaataggggagtcgagtgactcgccaaacagtgatgctcagaacgggcctctcaaagattcgttcccctttgagcgagacgttatctttgtggcaaatgctttgcatactctccagacatcatttattggcaagtcgactgagcttctcaacgagggcattcaagtacttttcaatcaagttgtaaaacttcgtctacggcctgttcttacggagacattccgtgatgcagattacaccttgtccgaagacgacattgccgatattgctcagcagaatgacgaagacgaggatgaactattggaacaagtgcctcggctcttcgagcacggatgggatcagctcatgaagccaattgcacgcataatgacacccgcaacgtataccactctactcgacatcaccgcacggtacctctccaagatttgggagaagaaaatcatgggctatgcaggccgaaccaatgctctcggtgcaatccgtctcgaacgtgactttattgcgttggtggatgtagtctcccgtggagattacgccgtgagagaggtgtttggcaaggtgctgcagtctctcatggttgccaacatggaagacgacgaatgggacgaaatcatggcacaagacggggaagatgatggcattgaatgggttctgactgatgaagagagaaggagggcgagaaccttggttagaggctga

SEQ ID NO: 73422 - protein, 802 aa, Gibberella zeae PH-1
MSSLPNGFSHNEYPVVESSIAVSTSSLDNATTEAEIRDALAALHTRETSITSRLDALVASQADLSRDLGRLDLLRAGLGAQVIAARSIGNDMLATAADTAGRLSDRVKELDLEKSRVEETLGVVEQVAELKACVNGVVGSMGAPQDWEAAAGYISRASNVPEEITKGSFAVGIVPSVEVPDPPWVTLEEAKESLCGLFLREFEKAAEESDGTKVTRFFKLFPLIGRAEVGLDVYGRYVCQGVAGTARATLKDAMNGQRREGFFYANALTKLFEHIAQIVEGHGGLVERHYGTGKMVRVIERLQMEADVQGGIIVDTWSDERGIDRKLTDVRSYPFSFLVQSFLPQPPRGGTPRVNSPAIGQGNNPRESEDEGVNMREVDGLLSEIAVMLGRWSLYTRFLAGKCKDAETPDEAPLVIPDVLVKSNLYRKVSTKLTSPYNVMTTFFFRRSVEKAFQLDEYPTGLSLSLSRHIEGNAPYIILAVDDVMYIVNTVIQKSISTSQRDVIASVVPTIGRVLGSDFVGMIQRKMRDESYPRPVVQGGFPPEDRIIQFIVLINSLDMANEYLTRIITGRIGESSDSPNSDAQNGPLKDSFPFERDVIFVANALHTLQTSFIGKSTELLNEGIQVLFNQVVKLRLRPVLTETFRDADYTLSEDDIADIAQQNDEDEDELLEQVPRLFEHGWDQLMKPIARIMTPATYTTLLDITARYLSKIWEKKIMGYAGRTNALGAIRLERDFIALVDVVSRGDYAVREVFGKVLQSLMVANMEDDEWDEIMAQDGEDDGIEWVLTDEERRRARTLVRG

SEQ ID NO: 73423 - DNA, 2568 bp, Candida glabrata CBS 138
  CDS (1)..(2568)
atgaatcaagactctgtgacgatagattcgaaccaattggccaagaacttagctagatatgaccttcttttaaggcgtatctcaactatctctcaagttcaccgtctaaaggaaatcatagaaaaggaccatgccgttcacctgaagaagctcgaccaatatgtgcacgagagccaattgagacacaacaagcaaataagaaagctagagctacaaagaacagacctaacggtgtcactgacacaatttcatgaagcattatccaatgtaaataaaacgaatgctgaagctaaacaaatccataatgacattaagtctgttgaactcgaaagggtattactgaagcaaactcttgaattcgttacaaatataaggactctcaaaaataatatatcactgtgtaatgctgtgatagatgaagaaaattaccaagttgctgcaagagccatacaagaaattagaaatatgccgaatagagatggtataattaactctgagtttgcaaagagagtaatcccatccagcaagattccagaggaaccatcagttattcttcaacaatggtgtgatgaactaaccgaaaagtttaaggagagattccagaaggctacagaagaacaaaatattgaagaactcactttgatctttaagatgtttccaatggtgggtcaggacaatctcggtcttgatctatattccaaatatgtttgtgatattattgcagatgaaagtcgtaaattaatgtccagttcggctaacgcagatgtagacgctacaattacgaggagatctggattttttgcacaagttctactacatctgttcaaaattgtctcgacaattattaatgaccattcgaaaattatcgctgcttcttatggtgtttctcacatgctgcacgtaatgggaaaagttcaaaaagaggccgatttggaagcgggcctagtctttgatatattcagcgacacaagaaaagtaaaatcggtagtaagagaaatatcagaatggaatattgctcaaaaaaacaagaataaaacacaagcctataaagattcaggaactgatcaaaatgcatctcaagaaaggaaaagcatggacaataaacttccttcaatatctaccggtgacttatcgggactaataggggagttttcacaaatattacaaaactggtcaatgtatctgaagttcttttctgtgagatggaatgaattttctaatgagaatccaagtgtcttgaccttaccatcttctttagagacaagtaagtttagcaacaaacttcgggaagaaagatacttagatgatttcctttccttgacaatttaccacttacagtcttcttttgctagaagtagaaccatagaagagcttccagatttgaatcacttagttataccaacaccaataaaaacaaatgacggtttagcctatcctgtatcttcagtagtggaagacttaactctgctcctaaggaaaggcttagttttgactgtcaattccggaaactttgaagtagtatcacagtttttagagaatttagtcagatttattcaaaatgactttttggtcaggtttatgcaagacagatttaagactttgcaaccaaaaatcacatcctctttgacactgaagaagtatgtgccaaaggatatctctgagactggtagtcctgattcgatctccagagtgggttcaccttctggctatggtgagaaatccagttccaacaagttatcacagcttggtagattcagtttacgtggcgctgccgcatccgcttttaccaatatacagtccaatttacaggctgttgtcacggacgaggactctgtattgtcattacaccattatttgatatacttaaacacattaaactggtccaaactattatgtaagaagttattgagagaagaactattggaggagaatcccaaactactgccggagagtttcccatttaacaatgagtcagatgttatcagggagaaaataaataaatgccaagatatgatcacgtcacagatatcaaaattggagaaatgggcagttaagtacttgttccaaaacttgatacagagcaaaatgagaactttactcacacctctttttgtaaacggtagcgataacacatatatcgcaaacacagaagactttgaggacatgtctgagatggtaaactttattaagaagtggaaacaactaataacaccataccagaacatcctccaccctgacgtatatacagaattacttgcgtatatcgttgagtactgtgtccagtcagtagagcagaagttcaacttgttacaggtgaacgaattgggttcaaccaagttagagaaagaattaagcttgttcataagcacactgtgctctctaaacttcatgttgaggaaggatttcaccaaattgacgcagatggttctcttactaggcttcgacgacgacgacttcgatctcgagaccggggacatcaaagaggaattcatggacacaattgactgggtgttaacaccagctgaacgtgttaacaccagaaaactaaaagtagatagaagacaatag

SEQ ID NO: 73424 - protein, 855 aa, Candida glabrata CBS 138
MNQDSVTIDSNQLAKNLARYDLLLRRISTISQVHRLKEIIEKDHAVHLKKLDQYVHESQLRHNKQIRKLELQRTDLTVSLTQFHEALSNVNKTNAEAKQIHNDIKSVELERVLLKQTLEFVTNIRTLKNNISLCNAVIDEENYQVAARAIQEIRNMPNRDGIINSEFAKRVIPSSKIPEEPSVILQQWCDELTEKFKERFQKATEEQNIEELTLIFKMFPMVGQDNLGLDLYSKYVCDIIADESRKLMSSSANADVDATITRRSGFFAQVLLHLFKIVSTIINDHSKIIAASYGVSHMLHVMGKVQKEADLEAGLVFDIFSDTRKVKSVVREISEWNIAQKNKNKTQAYKDSGTDQNASQERKSMDNKLPSISTGDLSGLIGEFSQILQNWSMYLKFFSVRWNEFSNENPSVLTLPSSLETSKFSNKLREERYLDDFLSLTIYHLQSSFARSRTIEELPDLNHLVIPTPIKTNDGLAYPVSSVVEDLTLLLRKGLVLTVNSGNFEVVSQFLENLVRFIQNDFLVRFMQDRFKTLQPKITSSLTLKKYVPKDISETGSPDSISRVGSPSGYGEKSSSNKLSQLGRFSLRGAAASAFTNIQSNLQAVVTDEDSVLSLHHYLIYLNTLNWSKLLCKKLLREELLEENPKLLPESFPFNNESDVIREKINKCQDMITSQISKLEKWAVKYLFQNLIQSKMRTLLTPLFVNGSDNTYIANTEDFEDMSEMVNFIKKWKQLITPYQNILHPDVYTELLAYIVEYCVQSVEQKFNLLQVNELGSTKLEKELSLFISTLCSLNFMLRKDFTKLTQMVLLLGFDDDDFDLETGDIKEEFMDTIDWVLTPAERVNTRKLKVDRRQ

SEQ ID NO: 73425 - DNA, 2304 bp, Kluyveromyces lactis NRRL Y-1140
  CDS (1)..(2304)
atggaaattgacgagtttcaactcgattcaaaactatcgaagttcgagaatctatcgggcaaattatcgaccaaatcacaattaccaaagctacttcatttgatagaagctgattatagtcagacttctaacgctttaaacaactatatcaaaggctcaaataataaaattaacaaatcggtaaggtccttggagttagggaagaccaatttaacatcaacattgtcttttttccatgaagccttggaatctctatctaattctaacgtgcaatcgatatcaatttccaataggcttaattccatcaaggatgaagcagaccatattaatcaattggcagattttgtagattctgtcaaacttttgaagaataacctaaaaataataaatgatgcattagacacgaaggaaccaaattacccaatgatagcccaatgtatctatgagattgatcagctgccagactctataatacactcgcagtttgttcagcggtgtgtacccactagtgaacttccagatccaccggttcagcttatagacaagtggaaaactcatctctgcaaagtattttctgataggtttaccagagccacaagagacgtggatgttggcacattgactgaatgcttcaaactatttccaaaaattggtgcttcggatcttggaatagatctttactccaaatatatatgtgataacattgcacaacaatccaggacgttaatgacacatacttccggggacccattattttattcaaaatccacactacaccttttcaaaattgtttctacgatgataaacgaccattccaagattattttgcaaagctattccactgatttcatgttagagatcatgcaaaaagttcaattagagactgatctacaagcttgtttgatttgggacaccttcactgatgatgtttcgttggataaagtcttcgcttcattgcaagataataatgacatgaggactttacaagccattatcttacaattttcgaatttcttgcaaaactggtcaatgtactgccagtttttctctatgaagtggttacaattcactaatgggtccgtagatccaatcaagattgtaccatgccttaccagcggtaagttcaattcaaaattgcaggacaatattgacactttccatgcattgactatccattacaccacatactgtttcaagagttctttgaaaacttcatgcatgccgaacttaaatgattctttggatattacattatctcaaaatactgaaagtaatcagcagattatttccccggtattggaagatctcgcgattcttataaaatcctacttggtttggactctaaattcgggacaaactgaattagttacgaaatctttagattcaatttcccaaatgattcaaaatgagtacttaatcagtttcgtacaatcaagcttgaccaaattaatacctaggttaacaccggcattgagattgcaaaaatatatatctgcgcccaattacccaatggatacgcaaagcaaatttacatcgcaattcgcggcatttaacctcaaggagacagatatggagtctgttttgcatttgcatcattatatcgtttaccttaacactatttctacaaatgaatcgatatttaaggatttgtttgagaacgaaattataaagattaatccacactttttgattgataatttcaaattcaataatgaacatgagctagttaaaggtaaacttctatctgtgctacagtatatccttgataataataagaagctttggaattgggcaataatgatgctatatcaaaatgttctgcaagaaaacctacatcgtctactatcggtactgttccaaagaaacaccgaattcttatccacattacaggattttgaagactttgaaaagctgcacaagtttgtagaagagtggaataaactattaaccccatacaaacaagtcctctccgcagcatctttcaacaatcttttgaccactattgtcaaagatgtttgtccaataatagagaacaagtttctatccctacaatttaacgaattaggttctatcaagattgagaaacagctatccattgttatcaaaactataagcatggacaattatcaattacgtgagtggtttaagaagttaacccagatgtgtctcctcttaggatttgaagacgaccagtttgactcaagcactcaagatctaaaagatgacgtgctcaattcattgaactggttattgacatcttctgaacgtatctcaataagacaacaacgtatcgacaaacggtag

SEQ ID NO: 73426 - protein, 767 aa, Kluyveromyces lactis NRRL Y-1140
MEIDEFQLDSKLSKFENLSGKLSTKSQLPKLLHLIEADYSQTSNALNNYIKGSNNKINKSVRSLELGKTNLTSTLSFFHEALESLSNSNVQSISISNRLNSIKDEADHINQLADFVDSVKLLKNNLKIINDALDTKEPNYPMIAQCIYEIDQLPDSIIHSQFVQRCVPTSELPDPPVQLIDKWKTHLCKVFSDRFTRATRDVDVGTLTECFKLFPKIGASDLGIDLYSKYICDNIAQQSRTLMTHTSGDPLFYSKSTLHLFKIVSTMINDHSKIILQSYSTDFMLEIMQKVQLETDLQACLIWDTFTDDVSLDKVFASLQDNNDMRTLQAIILQFSNFLQNWSMYCQFFSMKWLQFTNGSVDPIKIVPCLTSGKFNSKLQDNIDTFHALTIHYTTYCFKSSLKTSCMPNLNDSLDITLSQNTESNQQIISPVLEDLAILIKSYLVWTLNSGQTELVTKSLDSISQMIQNEYLISFVQSSLTKLIPRLTPALRLQKYISAPNYPMDTQSKFTSQFAAFNLKETDMESVLHLHHYIVYLNTISTNESIFKDLFENEIIKINPHFLIDNFKFNNEHELVKGKLLSVLQYILDNNKKLWNWAIMMLYQNVLQENLHRLLSVLFQRNTEFLSTLQDFEDFEKLHKFVEEWNKLLTPYKQVLSAASFNNLLTTIVKDVCPIIENKFLSLQFNELGSIKIEKQLSIVIKTISMDNYQLREWFKKLTQMCLLLGFEDDQFDSSTQDLKDDVLNSLNWLLTSSERISIRQQRIDKR

SEQ ID NO: 73427 - DNA, 2700 bp, Debaryomyces hansenii CBS767
  CDS (1)..(2700)
atgaacgagaactcgtatggaaacaacacgaaactcaatattaagggcctatttacaccacgatacctgctctacagttcaatatctatcgatattgagaatataatgtccggtaatggattcaatcagctggcacctttattttcgactctatctgagtcaaaactagataaaacggtactgacgttagatcaaaggttccatgaagcgactactacaaatgaattgcatagtttaatagctgaaatagatacaacaacagcttcaattgataaagaattgaatcatttttctataataaaactgaaaaagcatcaacaagaaacatccaatattgaattaaatcgggcgaaattatcgacaacaattctgaattcaaccgagatgactctgttattctcggcggctaatgatttaggacattcgttgacatttaagatcaaatcattggaccaggagattggtaacgtcaaacaaacgttgacttttgttagtgatatccaggcattaaagaataatataaatcaggcgagttatgctattgagcataaaaactgggaattggcagctcaatgtttacatactattacgagcaaactaccacctgaattggttaatggtaattttgcttctgtggtgatacccagtactgatattcctgagttaccttctgtaactgtacaaaaatggattgaattgttaacagaagaatttcaaaaagggtttaatgaagcatcaaaaaatagaaatgtttctgagttaacaaaatacttccagttgtttccattgattcaaaaagaggaaataggtctcaattgctattctaaattcatttgccaaataataaccgataccctgcgttcattgattaattccgcatctggcggcagtaatgctgccaccaaacatggcatgtacctaactataagtatgaaattatttgaaaatatatctatgatgttgtctcagcatggaccattgatcaagaaatattacggctctacatatgacaatgcaatttcatacgttgtaacaaaaatacagcatgaaattgattcacagattggtttgattagtgacactttctatgatataaaaagaattgataaagtcattcaagacattagtctctataacttccctgttttgtcaaaaaggttttcagaccatgaagatccctccggtgttgaccaagcaaatgtaaatccagaggaagatgaattggtttccattgttgaaattggtgacttggtaagtgagttggctggcatcctacataattgggccttgtattgtaaattcatcacattaaagtattatcaatctaatgacggtactgataacgatgagggattgaagcttccaaaattaattatggattccaatttcacaggtaagattcacaagaaattcttgcctgcatttgaatccttatattcctattatttcagaagatctttggagaaagctataaccattgaagaattgccatcattagaaccacatttgataatgacttcgtcatcagatccgcctgatcaagtaccttgttcatctgttatagaagatgctacattggtgttaaacaccaccttaagaaacataatagacacggcgcagccaatcacactcaaaagattcataaacgaagacttcaaagttattcagcgggacttaattaatggattctttatcaaaaatttaaattctaatcagcctcgttataactctacattgactttagtggcacctacatcaaatccaaatggcgtactcagtggtactgccagtcctggaatatctagaagtgggacgccagtccacgaaggttcaggtactatgggattttttaaaggtgcttctagtgctttgggtaatgttgtcggaagcggtgcgtctgccggagctggaatcagtacaactgccgcacatactaataatgctaagttaatgaattttgtattatatttaaatactgttgcaatggggcaagagtactttacaaagatttttgaaagcataaccaaaaataatccggactacttaagaaataacttcccctttggtaaagacctggaaaagattgcaagcatacttaaaacagaatttttggatccatttatatcaatcaccaataagattattcaagatagtttaattaacttttacaatcaatcgcttaagaataaattgcttaatcttattaacgattgttttcctgatgctaacgattcacactatataatatactccgtcaactctctaaatgatacttcaactatcttgagattcacaacaacgtggcaatcgttgatcagaccatataagcaaacgtttcataagtcattaattttccataaactcttgaggttattggttgtgaacttggccaatttgatcgagaaaaaattggtgaatgtgttaaaaaagttcaaaataaatgaattgggatcgcttaagttagaaaaggatatgtctcacattattaatgaaatgtgtgaagataactatgaattaagagaaaagtttgtaagagtaactcaattagttttacttgttggtatggatgacgaggaatacgacatgagtaacgaaggtggtcataacaatgatgaaggtgatcaagcgggcgatgatttgggtgttaattgggttttgactccaatggaaagaaagcaggctagaaaatttagggtttaa

SEQ ID NO: 73428 - protein, 899 aa, Debaryomyces hansenii CBS767
MNENSYGNNTKLNIKGLFTPRYLLYSSISIDIENIMSGNGFNQLAPLFSTLSESKLDKTVLTLDQRFHEATTTNELHSLIAEIDTTTASIDKELNHFSIIKLKKHQQETSNIELNRAKLSTTILNSTEMTLLFSAANDLGHSLTFKIKSLDQEIGNVKQTLTFVSDIQALKNNINQASYAIEHKNWELAAQCLHTITSKLPPELVNGNFASVVIPSTDIPELPSVTVQKWIELLTEEFQKGFNEASKNRNVSELTKYFQLFPLIQKEEIGLNCYSKFICQIITDTLRSLINSASGGSNAATKHGMYLTISMKLFENISMMLSQHGPLIKKYYGSTYDNAISYVVTKIQHEIDSQIGLISDTFYDIKRIDKVIQDISLYNFPVLSKRFSDHEDPSGVDQANVNPEEDELVSIVEIGDLVSELAGILHNWALYCKFITLKYYQSNDGTDNDEGLKLPKLIMDSNFTGKIHKKFLPAFESLYSYYFRRSLEKAITIEELPSLEPHLIMTSSSDPPDQVPCSSVIEDATLVLNTTLRNIIDTAQPITLKRFINEDFKVIQRDLINGFFIKNLNSNQPRYNSTLTLVAPTSNPNGVLSGTASPGISRSGTPVHEGSGTMGFFKGASSALGNVVGSGASAGAGISTTAAHTNNAKLMNFVLYLNTVAMGQEYFTKIFESITKNNPDYLRNNFPFGKDLEKIASILKTEFLDPFISITNKIIQDSLINFYNQSLKNKLLNLINDCFPDANDSHYIIYSVNSLNDTSTILRFTTTWQSLIRPYKQTFHKSLIFHKLLRLLVVNLANLIEKKLVNVLKKFKINELGSLKLEKDMSHIINEMCEDNYELREKFVRVTQLVLLVGMDDEEYDMSNEGGHNNDEGDQAGDDLGVNWVLTPMERKQARKFRV

SEQ ID NO: 73429 - DNA, 2502 bp, Aspergillus nidulans FGSC A4
  CDS (1)..(2502)
atggctactgtctcggatgctgcgactgccgggagaatgttcaattccacagtcaatgttgtcaacggatactcggagacagagctaactacgcaatcttcgaactcgttttcctccgatatctacaatgctagctccgtcgccgagattaaggccaccttgacccaactgcacgagcaggaggcggcagttacagctcgcctagatgccctcgtcgcctcacagaaggatttctcgcgtgaattaggtcgattggaccttctccgcgcccaccttggctcccaaacaagcaccacacgagcgatcagcaatggcatgctcgtgggggccgccgcaaccgcagaccgcatctccagtgctgttcgacgtttagatctagaacagtcaagggtgaaaaagaccttggaggttgtcgaacaagtgtcggaattgaaagcatgcgtactaggtgttgccggctccatgggggcccctcaggactgggagagggcagctagctatctggaccgggcagccaaagtgcccccagaagtggttcagggcgcctttgcggcagaaatggttcctacggcggaggttccggacccgccgagcgtgacgctagacaatgcggctgagtcgttgtgcgggctgtttctgcgcgagtttgataaggccgttaaagagagcaatggagctaagattacgcgattcttcaaactgtttccgttgatcgggcgctccgaggtcgggctggatgtctacgggcgatatgtctgtcaaggcgtggcagcaaaagcgcggtcgaacctaaatacgggaactgggcaacaggacggttttttctacgccaacacgctcactaagctgtttgagcatatcgcgcagattatcgacggtcatggagggcttgttgagcgccactacggccctcgaaaaatgaatagggtgattgagcgcctgcagctagaggcagatgtccaaggcgggattgtcgtcgacacatggagcgacgagcggcatatcgaccgcaaactgatggatatcaagtcatacgcctttacctttctggttcagagcttccttcctccacagcgcaccgcaacgccacatgcgaattccccggccactcaacagagcgcggcggaggacgaaggggtagacatgaaagagatagatgggttattgaatgagatgaccgtcatgctaagtcgatggtcactttacacccgcttcctagcagagacatgcaatgccaacgaggagcaaaagtttgaactgccccagttcctcaaggaatccgcgctttccaagaagatcgaggaccgggttatatccccgtttaataccatgacaaccttcttcttccgacggtcggttgagaaagcgttccagctagatgagcagccgacgggcttgactttgaacctccagcggccattgaaagcagatccaccacacataacgtccgcagttgacgatattatgtatatcgtaaacaaggtcctgcagcaatccctctcaacttcacaaattgctgtcgtcaccagcgtcgtccctaccttatcgcgtgtgctcggttccgactttattgggatgactcaacgcaagatgcgcgacgaatgctatccacgagccccccaccagggcgcctctccaccagagcatatcgtcatctccttcctagtcctgataaataacctcgatgtcgcagtggactatatccggcgcattgtccaaaacattaccgagaccaagaaaacaatcaccaacccagacgggcaggtcgaagaaactggccaactacacacgctcttcccatccccagcagatgcaaccctcgtatctcagaccctcacctcgctccttaccagctttgaagcgaaagttaccgaccttctcgcagacggcatacaagtcgttttcaacaacatcatcaaacaccgcctccgccccatcctctccgacgctttccgcgacatcgaataccaacctgcctctgactccaccccgctaacaacttaccactctgacctagactcctactctgatactgactcgatcccacatgacaatgaccccgaatcgccccgcgaaatcgtccggccccgtttcagcgccgcctggactgagctgctaggtcccatcttgcgcatcctcaaccccgccgcgttcgatcgcctcttaacagtaacaactgcctatctagcccggctcttggaaaagcgcctatgggcctaccacggccgcatcaatgccctcggcgcaacgcgtctggagcgcgacgttgcgggcatcgttagcgccgctgtcagtgttgatgtccctggttctgcgggggtaagcgtttccgggaggtacaggcaccgcgagacctttgggcggtgtctccaaatggttcttgttatggggatggatgaggatgagtgggatgatgtgttgcgtggtggggagacggccgatgtgcttgataaattgagcggggacgagaggagaagggtcagggggatggtcaggcggtag

SEQ ID NO: 73430 - protein, 833 aa, Aspergillus nidulans FGSC A4
MATVSDAATAGRMFNSTVNVVNGYSETELTTQSSNSFSSDIYNASSVAEIKATLTQLHEQEAAVTARLDALVASQKDFSRELGRLDLLRAHLGSQTSTTRAISNGMLVGAAATADRISSAVRRLDLEQSRVKKTLEVVEQVSELKACVLGVAGSMGAPQDWERAASYLDRAAKVPPEVVQGAFAAEMVPTAEVPDPPSVTLDNAAESLCGLFLREFDKAVKESNGAKITRFFKLFPLIGRSEVGLDVYGRYVCQGVAAKARSNLNTGTGQQDGFFYANTLTKLFEHIAQIIDGHGGLVERHYGPRKMNRVIERLQLEADVQGGIVVDTWSDERHIDRKLMDIKSYAFTFLVQSFLPPQRTATPHANSPATQQSAAEDEGVDMKEIDGLLNEMTVMLSRWSLYTRFLAETCNANEEQKFELPQFLKESALSKKIEDRVISPFNTMTTFFFRRSVEKAFQLDEQPTGLTLNLQRPLKADPPHITSAVDDIMYIVNKVLQQSLSTSQIAVVTSVVPTLSRVLGSDFIGMTQRKMRDECYPRAPHQGASPPEHIVISFLVLINNLDVAVDYIRRIVQNITETKKTITNPDGQVEETGQLHTLFPSPADATLVSQTLTSLLTSFEAKVTDLLADGIQVVFNNIIKHRLRPILSDAFRDIEYQPASDSTPLTTYHSDLDSYSDTDSIPHDNDPESPREIVRPRFSAAWTELLGPILRILNPAAFDRLLTVTTAYLARLLEKRLWAYHGRINALGATRLERDVAGIVSAAVSVDVPGSAGVSVSGRYRHRETFGRCLQMVLVMGMDEDEWDDVLRGGETADVLDKLSGDERRRVRGMVRR

SEQ ID NO: 73431 - DNA, 2670 bp, Candida albicans SC5314
  CDS (1)..(2670): transl_table=12
atgaaacaaagtaatggaagcggtgcttctggttttcattcattcaaaggattaaatgaggcagaagtagcgaaaacaacagctgaattaaaagcgaaataccaatcatcgtccacccctaatgatttatataatttgattgatgagattgatgctgccatggctaacatagacaataatcttaataattttacagcattgaattccggtagactccaacaagatataaccaatatagagttggcaagaactactaaattgtcatctacaatttcaaattcgagtaaattaacgtcgattttttcacaagcaaatgatttgggccataagttgacgtttaaaatcaaatcattagatcaagaaattggcaatgtaaacaaaacgttggactacgtgacaaatattcaattattaaaaaataacatcaaccaagcaaattatgccattgaacacaaaaattgggaattggccgctcaatgtatacatactatcaattcaaaaatcccctctgaattgatttctggcaaatatgcatcggttgtgattccatccaccgagttgccagaactgcctacagttgcaatagctaattggatagataagttaacccaagtgtttaaggaaaaattcaccgaggcagcaaaagctaaaaatgttgaacaattgacgaaatttttccaattattcccactaatcaaccaggaagagataggtcttaactgttattccaaatttatttgtgaaatcatcaatgaaacatctaaaagtctaacagcagggttggagaatgcccatgatttgaaacccgctattttttctaatgttgtcatgcaattatttgagaacatttccatgatgttgtctcaacatggacctttaatcaaaaaatactatagtgctacatatccactggcattgtcatatgttattagcaaaatccaaagagaaatcgatttacaagttggaattattgctgacaccttttatgatttaagaagattagataaacattttcaagacatcaagctttacagttttcctgtattgacacgaagattggcagaattaaaagatcacccaaatcaagatcaggaatcaagaagaactagttttgatacatcagacgatttattaccaataagattaattggagatttaatacaagaattgtcttcaatttttgaaaactggacgttatactgccgatttataaccgtcaaatacttacaagaaccgaaacatagacaaaatgggaaagaagtagtgacaggaaaatcacctacggaagacaaagatgcattacttttacctgatttaattcgcaaatccacttttacaagaaaaattaatgaaaagcttttgccttcatttgaaacattgtacaagttttatttccgtcgttccatagaaaaatcaatcaccattgaagaattgccatcattagatgcatatttggtattaagtaacgagcctggagtacaccccgaacaagtacctatatcttctgttgttgaagatttgactttggtcctaaataacactttgcgtaacattattcaatctggtttacctacagcagtgaagagttttattaatgaaagtttcggcattgttcaacaagatttgttaaatggatttttcattaaaaacttgaatgacaatcaaccaagatataaccaaacattatcattgatagaccctgcaagtactattaaccgtactaatagtccaatcagtagaagtgctactccagatgtgcatggaggtagtggtggattatcaactggtgcaggatttttgaagggagcgtcaagtgccttgggaagtgtcgttagtggttctggtgcaattgtaggcagtttacaaaccactcccaataatacaaaattgttaagtttcatcatttatttgaacaccgtggctatggcacaagaatatttcacaaaagtatttcagaatataaataaggacagttacttacaatcatattatcctttcggtaaagacaagagtaaaatctcaaatattttacaacaagattttttggacccatttactagtgtaagtaacaaaatcatttcagaaagtttgattaatttatacaatcaactgatcaagaacaaattgttattgcttgttaatgaattctttacagatattccaacagccaataatgaaaacaattatgtgatttattcaagcaataacataaatgacccaacaatcttaattaaattcacgtcaaactggcagtcattaatgaaaccatacctacaaacattacacaaaactctttggagtaaattgttgcgattagtcgtggttaatttaaccaatttgttagaaaagaagttgttcatgatattaaataaattgaaaattaatgaattgggagctataaagctagagaaagatgtttcgtatttaattaatgaaatttgccgtgataattactatttgcgtgaaaaattcgttagattgactcaaattgtattattggtaggtatggatgatgaagagtacgaagaaagcaaccaaccagtaactaaagctcgtgaaactgaagaggatggaggagaaggaagagatgattttgacgatgaaattggtggtataaattgggtattaaccccacaggaaagaatccaaatacgtaaatacagaatttag

SEQ ID NO: 73432 - protein, 889 aa, Candida albicans SC5314
MKQSNGSGASGFHSFKGLNEAEVAKTTAELKAKYQSSSTPNDLYNLIDEIDAAMANIDNNLNNFTALNSGRLQQDITNIELARTTKLSSTISNSSKLTSIFSQANDLGHKLTFKIKSLDQEIGNVNKTLDYVTNIQLLKNNINQANYAIEHKNWELAAQCIHTINSKIPSELISGKYASVVIPSTELPESPTVAIANWIDKLTQVFKEKFTEAAKAKNVEQLTKFFQLFPLINQEEIGLNCYSKFICEIINETSKSLTAGLENAHDLKPAIFSNVVMQLFENISMMLSQHGPLIKKYYSATYPSALSYVISKIQREIDLQVGIIADTFYDLRRLDKHFQDIKLYSFPVLTRRLAELKDHPNQDQESRRTSFDTSDDLLPIRLIGDLIQELSSIFENWTLYCRFITVKYLQEPKHRQNGKEVVTGKSPTEDKDALLLPDLIRKSTFTRKINEKLLPSFETLYKFYFRRSIEKSITIEELPSLDAYLVLSNEPGVHPEQVPISSVVEDLTLVLNNTLRNIIQSGLPTAVKSFINESFGIVQQDLLNGFFIKNLNDNQPRYNQTLSLIDPASTINRTNSPISRSATPDVHGGSGGLSTGAGFLKGASSALGSVVSGSGAIVGSLQTTPNNTKLLSFIIYLNTVAMAQEYFTKVFQNINKDSYLQSYYPFGKDKSKISNILQQDFLDPFTSVSNKIISESLINLYNQSIKNKLLLLVNEFFTDIPTANNENNYVIYSSNNINDPTILIKFTSNWQSLMKPYLQTLHKTLWSKLLRLVVVNLTNLLEKKLFMILNKLKINELGAIKLEKDVSYLINEICRDNYYLREKFVRLTQIVLLVGMDDEEYEESNQPVTKARETEEDGGEGRDDFDDEIGGINWVLTPQERIQIRKYRI

SEQ ID NO: 73433 - DNA, 2481 bp, Aspergillus oryzae
  CDS (1)..(2481)
atgcctgaaactaatgtcggcgaggtcaatggacatgcggtggccccatcgccttcactagactctagcaaacctcttccgagctcctcgtccgatatcttcaatgccagctctctcgcggaaatcaaggctactttatcgcaccttcacgaacaggagacgtcggtgacagcccgattagatgcccttgtcgcctctcagaaggatttttcacgtgaattgggtcgattggatttgctccgtgcgcatctcggctcccaaaccaccaccacccggtccatcagccatggcatgctctcagaggccgcggccaccgcagagagaatatcgagcgcagtccgccgcctggatctggaacaatctagggtaaaatctactttggatgtagtggaacaggtttctgaacttaaggcctgtgtactgggagtcgcgggctccatgggtgccccgcaggattgggaaacagcagccagttatctgaaccgggcatccaaagtcccaccagaagttgttcatggagctttcgcggctgagatggtacccacggcggaagttccggacccgccaaatgtaaccttggataatgcggctgaatccctctgtggcttgttcttgcgcgaattcgataaggccgtcaaggagaataacggcgccaagatcacacggtttttcaagctgtttcctcttatcggccgctcggaggttggccttgacgtctacgggcgttacgtatgccagggcgtggcgtcacgagcgcggtccaacctcaacgctggggcaggaactcaaagcaaagatggcttcttctacgccaatgttctgaccaaattatttgaacatatcgctcagattgtcgatggccacgggggactagtagagcgacattacggtccgagaaagatgaaccgagttattgagcgactacaacttgaggcagatgtccaaggcggtatcattctcgacacctggggtgatgagagacatgtagatcgcaagctgactgacatcaaatcatatgcgtttactttcctagtacaaagctttctcccccctcagcgcagcgccacaccacggtcgaactcccctgcaactcgggacggggcttcaacagctgaggatgagggtgttgacatgaaagaggtcgacggattactgaatgaaatggcggttatgctaggtcgttggtcactatattgccgattcttggcagaaacatgcaatgctcctggtgaagacgataatctgtttacaccgcctcaattcttgaaggaatccactttatcgaaaaagatcaatgaccgacttatatctccattcaataccatgaccaccttcttcttccgtcggacagtggagaaggcattccagctagatgaacagcccactggcctgacattaaacccgcagaggccgctgaaggctgacccgccatatatcacctcggccgtcgatgacatcatgtatatagtcaacaaggtcctacagcaatcacttgcaacgtcgcagatcacagtggttaccaatgtagtgccgactctgtctcgggtgctaggctcagatttcattgggatgacacaacggaaaatgcgggacgaatgctatccgagagcatcggtacaaggagctcaacccccagagcatctgatagtctcttttctagtcttggtcaacaatctggatgtagccgttgattacattcgacgcatcgtgcaaactcataccgaaaccaggaagaccacaactggtcccgacgggcagactgaagagacggaccaattgcattccctctttcctaacaatgcagatgctaagctcgcagcgcagacgctgcaagccctatcatcatcttttgagtctaaggtcaacgaccttctgtccgatggcatccaagtagtgttcaacaacgtcatcaagcatcgtctgcgacccattttagcagacgcgttccgagatatcgattatcaacccggagatgacaatgaccccaccagcacttcgtaccatgagtacgaccgcgacgaggatgcggatgacaatgccagccgtgcggaacttgtccgaccgcgttttgcagccagttggactgaacttcttctcccaatatcccgtatacttaccacgtctgcctttgaccgcctcttaagtatcacggtagcttatctttcccgactcttggaaaagcgactctggtcgtatcaaggtcgtgtcaacgcactgggcgccacacgacttgagcgagacgtttcgggaattgctagcgcagcagtggatgtcggtggcacacacggggcaccgggaagataccgccaccgggagtcatttgctcgttgcatgcaaatgacgttgattatgggcatggatgacgacgaatgggaggatgttatacgtggaggcgagacggccgaagtagtcgagaaactgaaccgagaagaacggacaaggattcgaggaatggtgagacgacagggcactcaatactag

SEQ ID NO: 73434 - protein, 826 aa, Aspergillus oryzae
MPETNVGEVNGHAVAPSPSLDSSKPLPSSSSDIFNASSLAEIKATLSHLHEQETSVTARLDALVASQKDFSRELGRLDLLRAHLGSQTTTTRSISHGMLSEAAATAERISSAVRRLDLEQSRVKSTLDVVEQVSELKACVLGVAGSMGAPQDWETAASYLNRASKVPPEVVHGAFAAEMVPTAEVPDPPNVTLDNAAESLCGLFLREFDKAVKENNGAKITRFFKLFPLIGRSEVGLDVYGRYVCQGVASRARSNLNAGAGTQSKDGFFYANVLTKLFEHIAQIVDGHGGLVERHYGPRKMNRVIERLQLEADVQGGIILDTWGDERHVDRKLTDIKSYAFTFLVQSFLPPQRSATPRSNSPATRDGASTAEDEGVDMKEVDGLLNEMAVMLGRWSLYCRFLAETCNAPGEDDNLFTPPQFLKESTLSKKINDRLISPFNTMTTFFFRRTVEKAFQLDEQPTGLTLNPQRPLKADPPYITSAVDDIMYIVNKVLQQSLATSQITVVTNVVPTLSRVLGSDFIGMTQRKMRDECYPRASVQGAQPPEHLIVSFLVLVNNLDVAVDYIRRIVQTHTETRKTTTGPDGQTEETDQLHSLFPNNADAKLAAQTLQALSSSFESKVNDLLSDGIQVVFNNVIKHRLRPILADAFRDIDYQPGDDNDPTSTSYHEYDRDEDADDNASRAELVRPRFAASWTELLLPISRILTTSAFDRLLSITVAYLSRLLEKRLWSYQGRVNALGATRLERDVSGIASAAVDVGGTHGAPGRYRHRESFARCMQMTLIMGMDDDEWEDVIRGGETAEVVEKLNREERTRIRGMVRRQGTQY

SEQ ID NO: 73435 - DNA, 25 bp, Artificial sequence
  primer
atggaagggcaaaaatcgaatgcat

SEQ ID NO: 73436 - DNA, 27 bp, Artificial sequence
  primer
ttactgtgttctatcaatcttcatatt

SEQ ID NO: 73437 - protein, 896 aa, Artificial sequence
  consensus sequence
  Variant (2)..(17): Xaa in position 2 to 17 is any amino acid
  Variant (18)..(18): Xaa in position 18 is any or no amino acid
  Variant (20)..(20): Xaa in position 20 is any amino acid
  Variant (22)..(22): Xaa in position 22 is any amino acid
  Variant (24)..(59): Xaa in position 24 to 59 is any amino acid
  Variant (60)..(60): Xaa in position 60 is any or no amino acid
  Variant (62)..(64): Xaa in position 62 to 64 is any amino acid
  Variant (66)..(67): Xaa in position 66 to 67 is any amino acid
  Variant (70)..(71): Xaa in position 70 to 71 is any amino acid
  Variant (73)..(77): Xaa in position 73 to 77 is any amino acid
  Variant (80)..(96): Xaa in position 80 to 96 is any amino acid
  Variant (97)..(98): Xaa in position 97 to 98 is any or no amino acid
  Variant (101)..(109): Xaa in position 101 to 109 is any amino acid
  Variant (111)..(117): Xaa in position 111 to 117 is any amino acid
  Variant (118)..(119): Xaa in position 118 to 119 is any or no amino acid
  Variant (122)..(125): Xaa in position 122 to 125 is any amino acid
  Variant (127)..(128): Xaa in position 127 to 128 is any amino acid
  Variant (130)..(130): Xaa in position 130 is any amino acid
  Variant (132)..(133): Xaa in position 132 to 133 is any amino acid
  Variant (135)..(144): Xaa in position 135 to 144 is any amino acid
  Variant (146)..(148): Xaa in position 146 to 148 is any amino acid
  Variant (150)..(152): Xaa in position 150 to 152 is any amino acid
  Variant (154)..(155): Xaa in position 154 to 155 is any amino acid
  Variant (157)..(165): Xaa in position 157 to 165 is any amino acid
  Variant (167)..(168): Xaa in position 167 to 168 is any amino acid
  Variant (170)..(170): Xaa in position 170 is any amino acid
  Variant (174)..(174): Xaa in position 174 is any amino acid
  Variant (177)..(180): Xaa in position 177 to 180 is any amino acid
  Variant (183)..(184): Xaa in position 183 to 184 is any amino acid
  Variant (186)..(187): Xaa in position 186 to 187 is any amino acid
  Variant (189)..(189): Xaa in position 189 is any amino acid
  Variant (191)..(193): Xaa in position 191 to 193 is any amino acid
  Variant (195)..(197): Xaa in position 195 to 197 is any amino acid
  Variant (199)..(209): Xaa in position 199 to 209 is any amino acid
  Variant (210)..(218): Xaa in position 210 to 218 is any or no amino acid
  Variant (220)..(226): Xaa in position 220 to 226 is any amino acid
  Variant (229)..(237): Xaa in position 229 to 237 is any amino acid
  Variant (239)..(245): Xaa in position 239 to 245 is any amino acid
  Variant (248)..(250): Xaa in position 248 to 250 is any amino acid
  Variant (251)..(253): Xaa in position 251 to 253 is any or no amino acid
  Variant (255)..(256): Xaa in position 255 to 256 is any amino acid
  Variant (258)..(261): Xaa in position 258 to 261 is any amino acid
  Variant (263)..(263): Xaa in position 263 is any amino acid
  Variant (265)..(265): Xaa in position 265 is any amino acid
  Variant (267)..(267): Xaa in position 267 is any amino acid
  Variant (269)..(269): Xaa in position 269 is any amino acid
  Variant (271)..(271): Xaa in position 271 is any amino acid
  Variant (273)..(273): Xaa in position 273 is any amino acid
  Variant (276)..(277): Xaa in position 276 to 277 is any amino acid
  Variant (279)..(279): Xaa in position 279 is any amino acid
  Variant (281)..(288): Xaa in position 281 to 288 is any amino acid
  Variant (290)..(300): Xaa in position 290 to 300 is any amino acid
  Variant (301)..(339): Xaa in position 301 to 339 is any or no amino acid
  Variant (341)..(342): Xaa in position 341 to 342 is any amino acid
  Variant (344)..(347): Xaa in position 344 to 347 is any amino acid
  Variant (349)..(350): Xaa in position 349 to 350 is any amino acid
  Variant (353)..(353): Xaa in position 353 is any amino acid
  Variant (355)..(356): Xaa in position 355 to 356 is any amino acid
  Variant (358)..(372): Xaa in position 358 to 372 is any amino acid
  Variant (373)..(396): Xaa in position 373 to 396 is any or no amino acid
  Variant (398)..(407): Xaa in position 398 to 407 is any amino acid
  Variant (409)..(415): Xaa in position 409 to 415 is any amino acid
  Variant (416)..(417): Xaa in position 416 to 417 is any or no amino acid
  Variant (419)..(427): Xaa in position 419 to 427 is any amino acid
  Variant (430)..(437): Xaa in position 430 to 437 is any amino acid
  Variant (439)..(439): Xaa in position 439 is any amino acid
  Variant (441)..(442): Xaa in position 441 to 442 is any amino acid
  Variant (443)..(445): Xaa in position 443 to 445 is any or no amino acid
  Variant (447)..(461): Xaa in position 447 to 461 is any amino acid
  Variant (462)..(462): Xaa in position 462 is any or no amino acid
  Variant (464)..(466): Xaa in position 464 to 466 is any amino acid
  Variant (468)..(475): Xaa in position 468 to 475 is any amino acid
  Variant (477)..(483): Xaa in position 477 to 483 is any amino acid
  Variant (485)..(516): Xaa in position 485 to 516 is any amino acid
  Variant (518)..(538): Xaa in position 518 to 538 is any amino acid
  Variant (539)..(603): Xaa in position 539 to 603 is any or no amino acid
  Variant (605)..(625): Xaa in position 605 to 625 is any amino acid
  Variant (626)..(639): Xaa in position 626 to 639 is any or no amino acid
  Variant (641)..(643): Xaa in position 641 to 643 is any amino acid
  Variant (646)..(656): Xaa in position 646 to 656 is any amino acid
  Variant (658)..(670): Xaa in position 658 to 670 is any amino acid
  Variant (671)..(671): Xaa in position 671 is any or no amino acid
  Variant (673)..(688): Xaa in position 673 to 688 is any amino acid
  Variant (690)..(696): Xaa in position 690 to 696 is any amino acid
  Variant (698)..(718): Xaa in position 698 to 718 is any amino acid
  Variant (719)..(743): Xaa in position 719 to 743 is any or no amino acid
  Variant (745)..(747): Xaa in position 745 to 747 is any amino acid
  Variant (749)..(750): Xaa in position 749 to 750 is any amino acid
  Variant (752)..(753): Xaa in position 752 to 753 is any amino acid
  Variant (755)..(758): Xaa in position 755 to 758 is any amino acid
  Variant (760)..(766): Xaa in position 760 to 766 is any amino acid
  Variant (767)..(767): Xaa in position 767 is any or no amino acid
  Variant (770)..(780): Xaa in position 770 to 780 is any amino acid
  Variant (782)..(789): Xaa in position 782 to 789 is any amino acid
  Variant (790)..(793): Xaa in position 790 to 793 is any or no amino acid
  Variant (795)..(795): Xaa in position 795 is any amino acid
  Variant (798)..(800): Xaa in position 798 to 800 is any amino acid
  Variant (803)..(805): Xaa in position 803 to 805 is any amino acid
  Variant (807)..(816): Xaa in position 807 to 816 is any amino acid
  Variant (817)..(828): Xaa in position 817 to 828 is any or no amino acid
  Variant (830)..(831): Xaa in position 830 to 831 is any amino acid
  Variant (834)..(834): Xaa in position 834 is any amino acid
  Variant (836)..(839): Xaa in position 836 to 839 is any amino acid
  Variant (841)..(842): Xaa in position 841 to 842 is any amino acid
  Variant (844)..(845): Xaa in position 844 to 845 is any amino acid
  Variant (847)..(847): Xaa in position 847 is any amino acid
  Variant (851)..(867): Xaa in position 851 to 867 is any amino acid
  Variant (868)..(886): Xaa in position 868 to 886 is any or no amino acid
  Variant (888)..(890): Xaa in position 888 to 890 is any amino acid
  Variant (893)..(895): Xaa in position 893 to 895 is any amino acid
LXXXXXXXXXXXXXXXXXLXLXRXXXXXXXXXXXXXXXXXXXXXXXXXXXXXXXXXXXXXEXXXVXXTLXXVXXXXXLKXXXXXXXXXXXXXXXXXXXAAXXXXXXXXXPXXXXXXXXXFAXXXXPXXEXPXXPXXXXXXXXXXLXXXFXXXFXXAXXXXXXXXXTXXFXLFPXIGXXXXGLXXYXXYXCXXXAXXXRXXXXXXXXXXXXXXXXXXXXFXXXXXXXLFXXXXXXXXXHXXXXXXXYGXXXXXXMXXVXXXXQXEXDXQXGXIXDTXXDXRXXXXXXXXIXXXXXXXXXXXXXXXXXXXXXXXXXXXXXXXXXXXXXXXXXXXXXXXXXXLXXEXXXXLXXWSXYXXFXXXXXXXXXXXXXXXXXXXXXXXXXXXXXXXXXXXXXXXPXXXXXXXXXXKXXXXXXXXXFXXXXXXXXXRSXXXXXXXXEXPXXXXXLXXXXXXXXXXXXXXXXSXXXDXXXXXXXXLXXXXXXXQXXXXXXXXXXXXXXXXXXXXXXXXXXXXXXXXPXXXXXXXXXXXXXXXXXXXXXXXXXXXXXXXXXXXXXXXXXXXXXXXXXXXXXXXXXXXXXXXXXXXXXXXXXXXXXXXXXXXXXXNXXXXXXXXXXXXXXXXXXXXXXXXXXXXXXXXXXXLXXXFPXXXXXXXXXXXLXXXXXXXXXXXXXXLXXXXXXXXXXXXXXXXLXXXXXXXFXXXXXXXXXXXXXXXXXXXXXXXXXXXXXXXXXXXXXXXXXXXXXXFXXXWXXLXXPXXXXLXXXXXXXXLLXXXXXXXXXXXEXXXXXXXXXXXXNXLGXXXLEXXXSXXXXXXXXXXXXXXXXXXXXXXYXXREXFXXXXQXXLXXGXDDDXXXXXXXXXXXXXXXXXXXXXXXXXXXXXXXXXXXXLXXXERXXXR

SEQ ID NO: 73438 - protein, 60 aa, Artificial sequence
  protein pattern
  Variant (2)..(4): Xaa in position 2 to 4 is any amino acid
  Variant (5)..(6): Xaa in position 5 to 6 is any or no amino acid
  Variant (8)..(13): Xaa in position 8 to 13 is any amino acid
  Variant (14)..(14): Xaa in position 14 is any or no amino acid
  Variant (16)..(16): Xaa in position 16 is Cys, Ser or Thr
  Variant (17)..(18): Xaa in position 17 to 18 is any amino acid
  Variant (20)..(20): Xaa in position 20 is any amino acid
  Variant (21)..(21): Xaa in position 21 is Asp, Glu or Arg
  Variant (22)..(22): Xaa in position 22 is Glu, Gln or Arg
  Variant (24)..(24): Xaa in position 24 is any amino acid
  Variant (25)..(25): Xaa in position 25 is Glu, His, Lys or Arg
  Variant (27)..(27): Xaa in position 27 is Ala, Thr or Val
  Variant (28)..(28): Xaa in position 28 is Glu, Lys or Arg
  Variant (29)..(29): Xaa in position 29 is Ala, Asp, Glu or Thr
  Variant (30)..(30): Xaa in position 30 is any amino acid
  Variant (31)..(31): Xaa in position 31 is Asp or Asn
  Variant (32)..(32): Xaa in position 32 is Gly, Ile or Val
  Variant (33)..(34): Xaa in position 33 to 34 is any amino acid
  Variant (35)..(35): Xaa in position 35 is Ile, Leu or Val
  Variant (37)..(38): Xaa in position 37 to 38 is any amino acid
  Variant (40)..(40): Xaa in position 40 is Glu or Lys
  Variant (41)..(41): Xaa in position 41 is Leu or Met
  Variant (44)..(44): Xaa in position 44 is any amino acid
  Variant (45)..(45): Xaa in position 45 is Ile or Val
  Variant (47)..(47): Xaa in position 47 is any amino acid
  Variant (48)..(48): Xaa in position 48 is Ala, Asp or Ser
  Variant (49)..(49): Xaa in position 49 is any amino acid
  Variant (50)..(50): Xaa in position 50 is Leu or Val
  Variant (52)..(52): Xaa in position 52 is Ile or Leu
  Variant (53)..(53): Xaa in position 53 is Asp or Glu
  Variant (54)..(54): Xaa in position 54 is Leu or Val
  Variant (56)..(56): Xaa in position 56 is Gly or Ser
  Variant (57)..(57): Xaa in position 57 is Lys or Arg
  Variant (59)..(59): Xaa in position 59 is Ile or Val
PXXXXXLXXXXXXXLXXXFXXXFXXAXXXXXXXXXTXXFXXFPXXGXXXXGXXXYXXYXC

SEQ ID NO: 73439 - protein, 28 aa, Artificial sequence
  protein pattern
  Variant (2)..(5): Xaa in position 2 to 5 is any or no amino acid
  Variant (7)..(7): Xaa in position 7 is any amino acid
  Variant (8)..(8): Xaa in position 8 is Glu, His or Arg
  Variant (9)..(9): Xaa in position 9 is Ile or Val
  Variant (10)..(10): Xaa in position 10 is Ile or Met
  Variant (11)..(11): Xaa in position 11 is Asp, Glu, Gly or Gln
  Variant (12)..(12): Xaa in position 12 is Lys or Arg
  Variant (13)..(13): Xaa in position 13 is Leu or Val
  Variant (14)..(14): Xaa in position 14 is Glu or Gln
  Variant (15)..(15): Xaa in position 15 is any amino acid
  Variant (17)..(17): Xaa in position 17 is Ala or Thr
  Variant (19)..(19): Xaa in position 19 is Leu or Val
  Variant (20)..(20): Xaa in position 20 is Glu or Gln
  Variant (21)..(21): Xaa in position 21 is Ala or Gly
  Variant (22)..(22): Xaa in position 22 is Cys, Gly or Ser
  Variant (23)..(23): Xaa in position 23 is Ile or Leu
  Variant (24)..(24): Xaa in position 24 is Ile or Val
  Variant (25)..(25): Xaa in position 25 is any amino acid
  Variant (27)..(27): Xaa in position 27 is any amino acid
  Variant (28)..(28): Xaa in position 28 is Phe or Trp
YXXXXMXXXXXXXXXEXDXXXXXXXDXX

SEQ ID NO: 73440 - protein, 27 aa, Artificial sequence
  protein pattern
  Variant (2)..(3): Xaa in position 2 to 3 is any or no amino acid
  Variant (5)..(6): Xaa in position 5 to 6 is any or no amino acid
  Variant (8)..(8): Xaa in position 8 is any amino acid
  Variant (10)..(10): Xaa in position 10 is any amino acid
  Variant (11)..(11): Xaa in position 11 is Lys or Arg
  Variant (12)..(13): Xaa in position 12 to 13 is any amino acid
  Variant (15)..(15): Xaa in position 15 is Ile, Leu or Met
  Variant (16)..(16): Xaa in position 16 is Cys, Thr or Val
  Variant (18)..(18): Xaa in position 18 is Ile, Leu or Val
  Variant (19)..(19): Xaa in position 19 is Leu, Met or Val
  Variant (21)..(21): Xaa in position 21 is Phe, Leu or Met
  Variant (22)..(24): Xaa in position 22 to 24 is Asp or Glu
  Variant (25)..(25): Xaa in position 25 is Asp, Glu, Asn or Gln
  Variant (26)..(26): Xaa in position 26 is Phe, Trp or Tyr
  Variant (27)..(27): Xaa in position 27 is Asp or Glu
YXXRXXEXFXXXXQXXLXXGXXXXXXX

SEQ ID NO: 73441 - protein, 20 aa, Artificial sequence
  protein pattern
  Variant (2)..(2): Xaa in position 2 is any amino acid
  Variant (3)..(3): Xaa in position 3 is any or no amino acid
  Variant (5)..(5): Xaa in position 5 is Phe, Ile, Leu or Met
  Variant (6)..(6): Xaa in position 6 is Ala, Ser or Thr
  Variant (7)..(7): Xaa in position 7 is any amino acid
  Variant (8)..(8): Xaa in position 8 is Ile or Met
  Variant (9)..(9): Xaa in position 9 is Phe or Leu
  Variant (10)..(10): Xaa in position 10 is any amino acid
  Variant (11)..(11): Xaa in position 11 is Asn or Arg
  Variant (13)..(13): Xaa in position 13 is Ala, Ser or Thr
  Variant (14)..(14): Xaa in position 14 is Leu or Met
  Variant (16)..(16): Xaa in position 16 is any amino acid
  Variant (17)..(17): Xaa in position 17 is Lys or Arg
  Variant (19)..(19): Xaa in position 19 is any amino acid
  Variant (20)..(20): Xaa in position 20 is Ala, Ser or Thr
LXXEXXXXXXXWXXYXXFXX

SEQ ID NO: 73442 - protein, 24 aa, Artificial sequence
  protein pattern
  Variant (2)..(5): Xaa in position 2 to 5 is any amino acid
  Variant (6)..(6): Xaa in position 6 is any or no amino acid
  Variant (8)..(8): Xaa in position 8 is any amino acid
  Variant (9)..(10): Xaa in position 9 to 10 is any or no amino acid
  Variant (12)..(12): Xaa in position 12 is any amino acid
  Variant (13)..(13): Xaa in position 13 is Phe or Val
  Variant (14)..(14): Xaa in position 14 is Glu or Ser
  Variant (15)..(15): Xaa in position 15 is any amino acid
  Variant (16)..(16): Xaa in position 16 is Ile or Met
  Variant (17)..(17): Xaa in position 17 is Ala or Ile
  Variant (18)..(18): Xaa in position 18 is Asn or Gln
  Variant (19)..(20): Xaa in position 19 to 20 is any amino acid
  Variant (21)..(21): Xaa in position 21 is Asp, Glu or Ser
  Variant (22)..(23): Xaa in position 22 to 23 is any amino acid
  Variant (24)..(24): Xaa in position 24 is Gly or Ile
FXXXXXLXXXKXXXXXXXXXXXXX

SEQ ID NO: 73443 - protein, 24 aa, Artificial sequence
  protein pattern
  Variant (2)..(2): Xaa in position 2 is any amino acid
  Variant (3)..(3): Xaa in position 3 is Ala, Glu, Gly, Ser or Thr
  Variant (4)..(4): Xaa in position 4 is any amino acid
  Variant (6)..(7): Xaa in position 6 to 7 is any or no amino acid
  Variant (9)..(9): Xaa in position 9 is any or no amino acid
  Variant (12)..(12): Xaa in position 12 is Asp, Glu, Gln or Thr
  Variant (13)..(13): Xaa in position 13 is any amino acid
  Variant (14)..(14): Xaa in position 14 is Ile or Val
  Variant (15)..(15): Xaa in position 15 is any amino acid
  Variant (16)..(16): Xaa in position 16 is Asp, Asn or Gln
  Variant (17)..(17): Xaa in position 17 is any amino acid
  Variant (18)..(18): Xaa in position 18 is Gln, Arg or Ser
  Variant (19)..(19): Xaa in position 19 is any amino acid
  Variant (22)..(22): Xaa in position 22 is any amino acid
  Variant (23)..(23): Xaa in position 23 is Cys, Asn or Ser
  Variant (24)..(24): Xaa in position 24 is Ile or Val
EXXXVXXKXTLXXXXXXXXLKXXX

SEQ ID NO: 73444 - protein, 20 aa, Artificial sequence
  protein pattern
  Variant (2)..(2): Xaa in position 2 is any amino acid
  Variant (3)..(3): Xaa in position 3 is any or no amino acid
  Variant (5)..(5): Xaa in position 5 is Ala, Ile or Leu
  Variant (6)..(7): Xaa in position 6 to 7 is any amino acid
  Variant (8)..(9): Xaa in position 8 to 9 is Ile, Leu or Val
  Variant (10)..(12): Xaa in position 10 to 12 is any amino acid
  Variant (14)..(16): Xaa in position 14 to 16 is any amino acid
  Variant (17)..(17): Xaa in position 17 is Ile, Leu or Val
  Variant (18)..(18): Xaa in position 18 is Ala, Asp, Asn, Gln or Ser
  Variant (19)..(19): Xaa in position 19 is Ser or Thr
  Variant (20)..(20): Xaa in position 20 is Ala, Gly or Ser
VXXDXXXXXXXXLXXXXXXX

SEQ ID NO: 73445 - protein, 14 aa, Artificial sequence
  protein pattern
  Variant (2)..(2): Xaa in position 2 is Phe, Ile, Leu or Val
  Variant (3)..(4): Xaa in position 3 to 4 is any amino acid
  Variant (5)..(5): Xaa in position 5 is Ala or Ser
  Variant (6)..(6): Xaa in position 6 is any amino acid
  Variant (7)..(7): Xaa in position 7 is Asp, Gln, Ser or Thr
  Variant (8)..(8): Xaa in position 8 is Ile or Leu
  Variant (9)..(9): Xaa in position 9 is Asp or Glu
  Variant (11)..(11): Xaa in position 11 is any amino acid
  Variant (13)..(13): Xaa in position 13 is Asp, Ser or Thr
  Variant (14)..(14): Xaa in position 14 is Gly or Leu
SXXXXXXXXEXPXX

SEQ ID NO: 73446 - protein, 30 aa, Artificial sequence
  protein pattern
  Variant (2)..(10): Xaa in position 2 to 10 is any amino acid
  Variant (11)..(11): Xaa in position 11 is any or no amino acid
  Variant (13)..(18): Xaa in position 13 to 18 is any amino acid
  Variant (19)..(20): Xaa in position 19 to 20 is any or no amino acid
  Variant (22)..(22): Xaa in position 22 is Ala or Val
  Variant (23)..(25): Xaa in position 23 to 25 is any amino acid
  Variant (26)..(26): Xaa in position 26 is Ile or Val
  Variant (28)..(28): Xaa in position 28 is Cys, Ser or Thr
  Variant (29)..(29): Xaa in position 29 is Ala, Ser, Thr or Val
  Variant (30)..(30): Xaa in position 30 is Asp or Glu
AXXXXXXXXXXPXXXXXXXXFXXXXXPXXX

SEQ ID NO: 73447 - protein, 21 aa, Artificial sequence
  protein pattern
  Variant (2)..(3): Xaa in position 2 to 3 is any amino acid
  Variant (5)..(5): Xaa in position 5 is Ile, Leu or Met
  Variant (6)..(6): Xaa in position 6 is any amino acid
  Variant (8)..(9): Xaa in position 8 to 9 is any amino acid
  Variant (10)..(10): Xaa in position 10 is Asn, Gln or Arg
  Variant (11)..(11): Xaa in position 11 is any amino acid
  Variant (13)..(14): Xaa in position 13 to 14 is any amino acid
  Variant (15)..(15): Xaa in position 15 is Ala, Asp, Glu, Ser or Thr
  Variant (16)..(16): Xaa in position 16 is any amino acid
  Variant (17)..(17): Xaa in position 17 is Phe, Trp or Tyr
  Variant (18)..(19): Xaa in position 18 to 19 is any amino acid
  Variant (21)..(21): Xaa in position 21 is Ile or Leu
WXXLXXPXXXXLXXXXXXXLX

SEQ ID NO: 73448 - protein, 14 aa, Artificial sequence
  protein pattern
  Variant (2)..(2): Xaa in position 2 is Ala or Glu
  Variant (5)..(5): Xaa in position 5 is Ala, Ser or Val
  Variant (6)..(6): Xaa in position 6 is any amino acid
  Variant (7)..(7): Xaa in position 7 is Lys or Arg
  Variant (9)..(10): Xaa in position 9 to 10 is any or no amino acid
  Variant (12)..(12): Xaa in position 12 is any amino acid
  Variant (13)..(13): Xaa in position 13 is Asp or Ser
  Variant (14)..(14): Xaa in position 14 is Phe, Leu, Met or Val
NXLGXXXLXXEXXX

SEQ ID NO: 73449 - protein, 29 aa, Artificial sequence
  protein pattern
  Variant (2)..(9): Xaa in position 2 to 9 is any amino acid
  Variant (10)..(10): Xaa in position 10 is any or no amino acid
  Variant (12)..(12): Xaa in position 12 is any or no amino acid
  Variant (14)..(14): Xaa in position 14 is Asp or Glu
  Variant (16)..(16): Xaa in position 16 is any amino acid
  Variant (17)..(17): Xaa in position 17 is Lys or Arg
  Variant (18)..(18): Xaa in position 18 is Ala or Thr
  Variant (19)..(19): Xaa in position 19 is any amino acid
  Variant (21)..(21): Xaa in position 21 is Gly or Thr
  Variant (22)..(22): Xaa in position 22 is Ala, Ser, Thr or Val
  Variant (23)..(23): Xaa in position 23 is Gln, Ser or Thr
  Variant (24)..(27): Xaa in position 24 to 27 is any amino acid
  Variant (28)..(28): Xaa in position 28 is His or Arg
  Variant (29)..(29): Xaa in position 29 is Ala, Glu or Ser
SXXXXXXXXXRXLXLXXXXLXXXXXXXXX
